US007071375B2

(12) United States Patent
Brown et al.

(10) Patent No.: US 7,071,375 B2
(45) Date of Patent: Jul. 4, 2006

(54) NUCLEAR FERTILITY RESTORER GENES AND METHODS OF USE IN PLANTS

(75) Inventors: Gregory G. Brown, Montreal (CA); Natasa Formanova, Jena (DE); Charles Dendy, St. Luc (CA); Benoit S. Landry, L'Acadie (CA); Wing Cheung, Brossard (CA); Jin Hua, St-Jean-sur-Richlieu (CA)

(73) Assignees: McGill University, Montreal (CA); DNA Landmarks, Inc., Quebec (CA)

( * ) Notice: Subject to any disclaimer, the term of this patent is extended or adjusted under 35 U.S.C. 154(b) by 407 days.

(21) Appl. No.: 10/195,144

(22) Filed: Jul. 12, 2002

(65) Prior Publication Data

US 2003/0126646 A1 Jul. 3, 2003

Related U.S. Application Data

(60) Provisional application No. 60/308,736, filed on Jul. 30, 2001, provisional application No. 60/305,363, filed on Jul. 13, 2001, provisional application No. 60/305,026, filed on Jul. 12, 2001.

(51) Int. Cl.
   C12N 15/82 (2006.01)
   C12N 15/29 (2006.01)
   A01H 1/02 (2006.01)
   A01H 5/00 (2006.01)
   A01H 5/10 (2006.01)

(52) U.S. Cl. .................. 800/274; 800/278; 800/303; 800/306; 435/320.1; 435/419; 536/23.6

(58) Field of Classification Search ............... 800/271, 800/274, 278, 287, 303, 306; 536/23.6; 435/320.1, 435/419
See application file for complete search history.

(56) References Cited

U.S. PATENT DOCUMENTS

| 5,750,867 | A | 5/1998 | Williams et al. ............ 800/205 |
| 5,880,331 | A | 3/1999 | Krebbers et al. ........... 800/205 |
| 5,914,447 | A | 6/1999 | Araya et al. ................ 800/274 |
| 5,973,233 | A | 10/1999 | Burns et al. ............... 800/306 |

FOREIGN PATENT DOCUMENTS

| WO | WO 97/49831 A1 | 12/1997 |
| WO | WO 98/54340    | * 12/1998 |
| WO | WO 02/088179   | 11/2002 |

OTHER PUBLICATIONS

Brown et al. The Plant Journal 35(2): 262-272 (2003).*
Araya et al. pp. 83-91 In: Plant Mitochondria, Brennicke et al, eds., VCH: Weinheim, Germany (1993).*
Singh et al. Genetics 143(1):505-516 (May 1996).*
Aubourg et al., 2000, "In *Arabidopsis thaliana*, 1% of the genome codes for a novel protein family unique to plants", Plant Mol. Biol. 42:603-613.
Bellaoui et al., 1999, "The restorer *Rfo* gene acts post-translationally on the stability of the ORF138 Ogura CMS-associated protein in reproductive tissues of rapeseed cybrids", Plant Mol. Biol. 40:893-902.
Coffin et al., 1997, "The *Neurospora crassa cya*-5 nuclear gene encodes a protein with a region of homology to the *Saccharomyces cerevisiae* PET309 protein and is required in a post-transcriptional step for the expression of the mitochondrially encoded COXI protein", Curr. Genet. 32:273-280.
Delourme et al., 1995, Breeding Double Low Restorer Lines in Radish Cytoplasmic Male Sterility of Rapeseed (*Brassica napus* L.), Proc. 9th Int. Rapeseed Cong. Cambridge, UK 1:6-8.
Delourme et al., 1998, "Characterisation of the radish introgression carrying the *Rfo* restorer gene for the Ogu-INRA cytoplasmic male sterility in rapeseed (*Brassica napus* L. . . . )", Theor. Appl. Genet. 97:129-134.
Fisk et al., 1999, "Molecular cloning of the maize gene *crpl* reveals similarity between regulators of mitochondrial and chloroplast gene expression", EMBO J. 18:2621-2630.
Grant et al., 1985, "Heterosis and combining ability estimates in spring-planted oilseed rape (*Brassica napus* L.)", Can J. Genet. Cytol. 27:472-478.
Grelon et al., 1994, "Ogura Cytoplasmic male-sterility (CMS)-associated *orf138*is translated into a mitochondrial membrane polypeptide in male-sterile *Brassica* cybrids", Mol. Gen. Genet. 243:540-547.
Manthey et al., 1995, "The product of the nuclear gene *PET309* is required for translation of mature mRNA and stability or production of intron-containing RNAs derived from the mitochondrial *COX1* locus of *Saccharomyces cerevisiae*", EMBO J. 14:4031-4043.
Schnable et al., 1998, "The molecular basis of cytoplasmic male sterility and fertility restoration", Trends in Plant Sci. 3:175-180.
Small et al., 2000, "The PPR motif-a TPR-related motif prevalent in plant organellar proteins", Trends Biochem. Sci. 25:46-47.

(Continued)

Primary Examiner—David T. Fox
(74) Attorney, Agent, or Firm—Sutherland Asbill & Brennan LLP

(57) ABSTRACT

The present invention includes nuclear fertility restorer genes, proteins encoded by those genes and transgenic plants and plant cells containing those genes. More particularly, the nuclear fertility restorer genes can be used to restore fertility in cytoplasmic male-sterile plants such as *Brassica napus*. Preferably, the nuclear fertility restorer genes are used with the Ogura (ogu) CMS system in *Brassica napus*.

28 Claims, 17 Drawing Sheets

OTHER PUBLICATIONS

Cui, Xianggin, et al., "The rf2 Nuclear Restorer Gene of Male-Sterile T-Cytoplasm Maize," May 31, 1996, Science, vol. 272, pp. 1334-1336.

Delourme, R., et al., "Characterisation of the radish introgression carrying the Rfo restorer gene for the Ogu-INRA cytoplasmic male sterility in rapeseed (Brassica napus L.)," Theor Appl Genet (1998) 97: pp. 129-134.

Curtis et al., 2001, "Transgenic radish (Raphanus sativus L. longipinnatus Bailey) by floral-dip method—plant development and surfactant are important in optimizing transformation efficiency", Transgenic Res., 10(4)363-371.

Wu et al., May 2001, Identification and characterization of a putative light-harvesting chlorophyll a/b-binding protein gene encoded at a fertility restorer locus for the *Ogura* CMS in *Brassica napus* L. Theoretical and Applied Genetics, 102(5):759-766.

Buell et al., Database Accession No. AQ968799, "LERJE86TR LERG Arabidopsis thaliana genomic clone LERJE86, genomic survey sequence", Jan. 31, 2000.

Shin et al., Database Accession No. AC008047, "Genomic sequence for Arabidopsis thaliana BAC F2K11 from chromosome 1, complete sequence", Jul. 19, 1999.

Town et al., Database Accession No. BH710001, "BOMCR36TR B0_2_3_KB Brassica oleracea genomic clone BOMCR36, DNA sequence", Feb. 25, 2002.

* cited by examiner

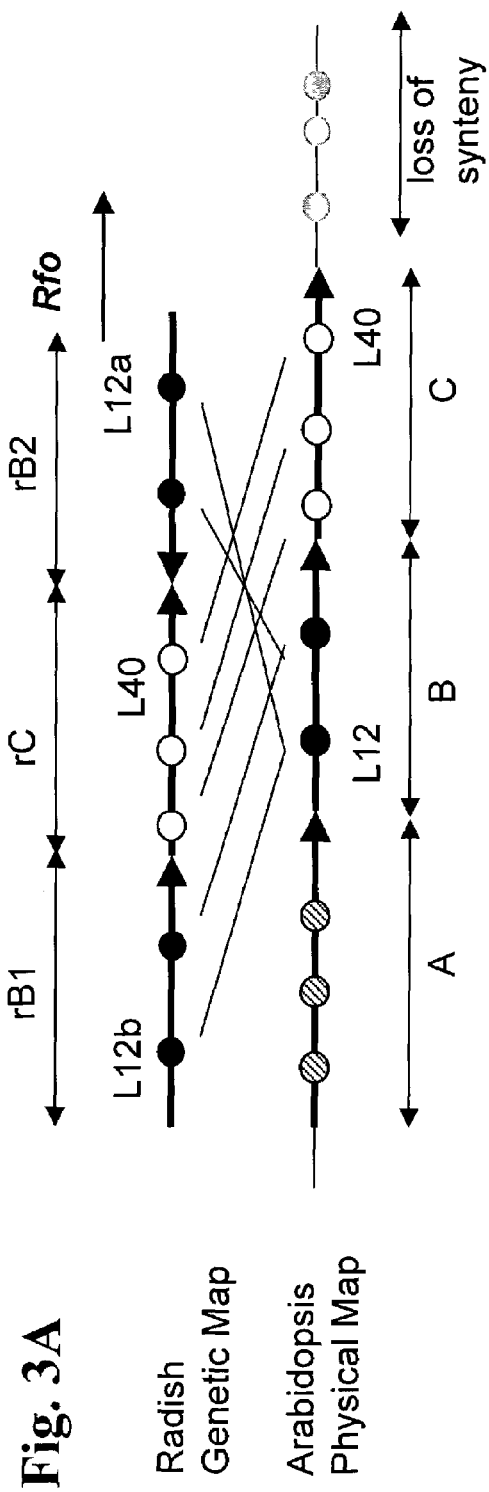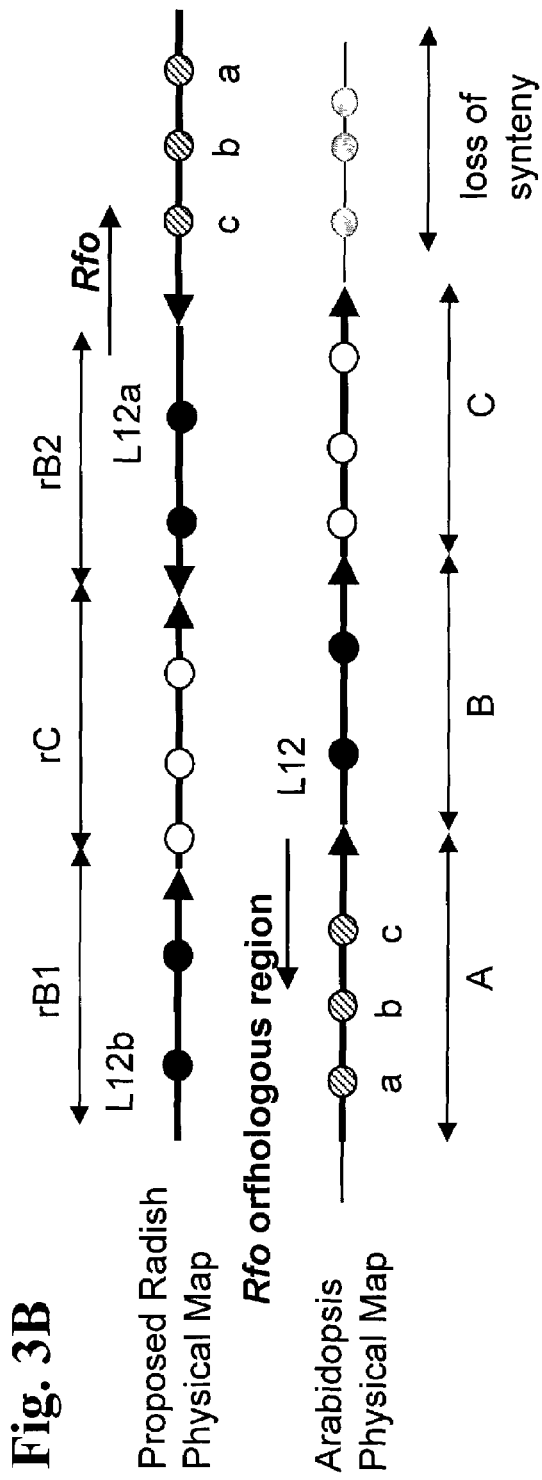
Fig. 3A
Fig. 3B

5'RACE cDNA amplification

3'RACE cDNA amplification

```
                    Fig. 9  Gene 16 cDNA and Protein
        10        20        30        40        50        60        70
....|....|....|....|....|....|....|....|....|....|....|....|....|....|
atgaggattgatgtttctgagccagagctatgcggttgcgacacttgtgtccagcatcggactttcatta
 M  R  I  D  V  S  E  P  E  L  C  G  C  D  T  C  V  Q  H  R  T  F  I
              5              10             15             20
        80        90       100       110       120       130       140
....|....|....|....|....|....|....|....|....|....|....|....|....|....|
ctcaagaaaccgagccgagcaaagaagtgattggctcatcggttcctgttagttccgaaccagttcaacc
 T  Q  E  T  E  P  S  K  E  V  I  G  S  S  V  P  V  S  S  E  P  V  Q  P
     25             30             35             40             45
       150       160       170       180       190       200       210
....|....|....|....|....|....|....|....|....|....|....|....|....|....|
tcttggttccacctcagatgagagttcaggaacagagacgactccactcgctcctcctccagtcaccaca
    L  G  S  T  S  D  E  S  S  G  T  E  T  T  P  L  A  P  P  V  T  T
       50             55             60             65             70
       220       230       240       250       260       270       280
....|....|....|....|....|....|....|....|....|....|....|....|....|....|
ccggttaataatcctgaaccagcagcgcagtctgttggctcaaccatcccacctgctgttacaccagtta
 P  V  N  N  P  E  P  A  A  Q  S  V  G  S  T  I  P  P  A  V  T  P  V
           75             80             85             90
       290       300       310       320       330       340       350
....|....|....|....|....|....|....|....|....|....|....|....|....|....|
gttccgaacaaccagcacaagctcttggttccacctcggatcaaagttccggtacagagaccactccact
 S  S  E  Q  P  A  Q  A  L  G  S  T  S  D  Q  S  S  G  T  E  T  T  P  L
 95            100            105            110            115
       360       370       380       390       400       410       420
....|....|....|....|....|....|....|....|....|....|....|....|....|....|
cgctcctcctatcaccacgtcggttaagtctgttgactcgaccatcttcttcaagttcccaccggtacaa
    A  P  P  I  T  T  S  V  K  S  V  D  S  T  I  F  F  K  F  P  P  V  Q
       120            125            130            135            140
       430       440       450       460       470       480       490
....|....|....|....|....|....|....|....|....|....|....|....|....|....|
gcacaagctcttgcccctactgcttccggttcaacgcaagcccctgcttttggttttggtgcattcgctg
 A  Q  A  L  A  P  T  A  S  G  S  T  Q  A  P  A  F  G  F  G  A  F  A
           145            150            155            160
       500       510       520       530       540       550       560
....|....|....|....|....|....|....|....|....|....|....|....|....|....|
ctcgcgtaccatctgccacctccggttgttcagcatttagtttcgcccctcctgttacatcggcaccagt
 A  R  V  P  S  A  T  S  G  C  S  A  F  S  F  A  P  P  V  T  S  A  P  V
   165            170            175            180            185
       570       580       590       600       610       620       630
....|....|....|....|....|....|....|....|....|....|....|....|....|....|
gcaagctctaggcacaaccactactactactactactacatccgcggccgctcctgcatctccatttcac
 Q  A  L  G  T  T  T  T  T  T  T  T  S  A  A  A  P  A  S  P  F  H
       190            195            200            205            210
       640       650       660       670       680       690       700
....|....|....|....|....|....|....|....|....|....|....|....|....|....|
agttcctcaccaaccacattccaattccctcctgcttttacatcccttgctgcttctacttttccttctg
    S  S  S  P  T  T  F  Q  F  P  P  A  F  T  S  L  A  A  S  T  F  P  S
           215            220            225            230
       710       720       730       740       750       760       770
....|....|....|....|....|....|....|....|....|....|....|....|....|....|
ttgcatcatcaacttcatctccacttgatgctcctccctcaccatttagatggggatcactgcaagctaa
 V  A  S  S  T  S  S  P  L  D  A  P  P  S  P  F  R  W  G  S  L  Q  A  N
 235            240            245            250            255
```

Fig. 9 Continued

```
         780       790       800       810       820       830       840
    ....|....|....|....|....|....|....|....|....|....|....|....|....|....|
    cacttccccacccctttagcttcttgccagcgcaaggttctgacaagactggttctgcttttactccaccg
      T  S  P  P  F  S  F  L  P  A  Q  G  S  D  K  T  G  S  A  F  T  P  P
        260           265           270           275           280
         850       860       870       880       890       900       910
    ....|....|....|....|....|....|....|....|....|....|....|....|....|....|
    tttggctaccctggtggttttgccagacctgatgttggtgtctctcatccagggtttggtccctctaacc
      F  G  Y  P  G  G  F  A  R  P  D  V  G  V  S  H  P  G  F  G  P  S  N
              285           290           295           300
         920       930       940       950       960       970       980
    ....|....|....|....|....|....|....|....|....|....|....|....|....|....|
    attttggaccaaacgcaccaactactacacctgttcctgttcgcagtccattttggctggtggtggaac
      H  F  G  P  N  A  P  T  T  T  P  V  P  V  R  S  P  F  L  A  G  G  T
    305           310           315           320           325
         990      1000      1010      1020      1030      1040      1050
    ....|....|....|....|....|....|....|....|....|....|....|....|....|....|
    tgaacaaggtagtaggtatcctcgttattcacctacaccagatgttgacggcaggctgataatgtccata
      E  Q  G  S  R  Y  P  R  Y  S  P  T  P  D  V  D  G  R  L  I  M  S  I
          330           335           340           345           350
        1060      1070      1080      1090      1100      1110      1120
    ....|....|....|....|....|....|....|....|....|....|....|....|....|....|
    tctgcttccaactcacatggacataaaagtcatgaagaattgaggtgggaagattacaaaaatggagaca
      S  A  S  N  S  H  G  H  K  S  H  E  E  L  R  W  E  D  Y  K  N  G  D
              355           360           365           370
        1130      1140      1150      1160      1170      1180      1190
    ....|....|....|....|....|....|....|....|....|....|....|....|....|....|
    aaggtgggtttgggtggtttcctcctgttcatacatctcccttttcctcaccaacggtatcaccgtcgct
      K  G  G  F  G  W  F  P  P  V  H  T  S  P  F  S  S  P  T  V  S  P  L
    375           380           385           390           395
        1200      1210      1220      1230      1240      1250      1260
    ....|....|....|....|....|....|....|....|....|....|....|....|....|....|
    atttgctcctccaagcatacctaatcgtcctcagatgagaactattgatctaacgaaccgagacatgtgt
      F  A  P  P  S  I  P  N  R  P  Q  M  R  T  I  D  L  T  N  R  D  M  C
        400           405           410           415           420
        1270      1280      1290      1300      1310      1320      1330
    ....|....|....|....|....|....|....|....|....|....|....|....|....|....|
    ggttttcctattggctacaacacccccgctgctttccagagaccccctgaacccgctggtgtttcttccc
      G  F  P  I  G  Y  N  T  P  A  A  F  Q  R  P  P  E  P  A  G  V  S  S
              425           430           435           440
        1340      1350      1360      1370      1380      1390      1400
    ....|....|....|....|....|....|....|....|....|....|....|....|....|....|
    cagcatctggatgcacagcgtgtggagccacgagtaggtcctctccttctagtcacttgggcttgaacaa
      P  A  S  G  C  T  A  C  G  A  T  S  R  S  S  P  S  S  H  L  G  L  N  N
    445           450           455           460           465
        1410      1420      1430      1440      1450      1460      1470
    ....|....|....|....|....|....|....|....|....|....|....|....|....|....|
    taccacaaatcctccatcagctgcgacatctcttcccgggatgttcttttctacctatggttcttgtcct
      T  T  N  P  P  S  A  A  T  S  L  P  G  M  F  F  S  T  Y  G  S  C  P
        470           475           480           485           490
        1480      1490      1500      1510      1520      1530      1540
    ....|....|....|....|....|....|....|....|....|....|....|....|....|....|
    ttgctgtttggctcaccaaatcttgcaacttatggtacaacagcaattccagcagtccaagcctatgcta
      L  L  F  G  S  P  N  L  A  T  Y  G  T  T  A  I  P  A  V  Q  A  Y  A
              495           500           505           510
```

Fig. 9 Continued

```
          1550      1560      1570      1580      1590      1600      1610
     ....|....|....|....|....|....|....|....|....|....|....|....|....|....|
     ttatgtttggggctccaaatttttacttctcaaggtacaacggcaactccagcttttcaagcctttcctat
      I  M  F  G  A  P  N  F  T  S  Q  G  T  T  A  T  P  A  F  Q  A  F  P  I
        515            520            525          530           535
          1620      1630      1640      1650      1660      1670      1680
     ....|....|....|....|....|....|....|....|....|....|....|....|....|....|
     tatgtttgggactccaaatcttgctgctcaaggtactacaagagctccagctgttcaagcctatcctacg
       M  F  G  T  P  N  L  A  A  Q  G  T  T  R  A  P  A  V  Q  A  Y  P  T
         540              545          550           555              560
          1690      1700      1710      1720      1730      1740      1750
     ....|....|....|....|....|....|....|....|....|....|....|....|....|....|
     atgtttggcacgccaaatattggagttcaaggttcaactccagcagctcaaacctatcctttgatgtttg
      M  F  G  T  P  N  I  G  V  Q  G  S  T  P  A  A  Q  T  Y  P  L  M  F
               565             570            575             580
          1760      1770      1780      1790      1800      1810      1820
     ....|....|....|....|....|....|....|....|....|....|....|....|....|....|
     gcacccccaaatcttgctgctcaaggtacaacaaatattggagctcgaggtacaactccagcagctcaagc
      G  T  P  N  L  A  A  Q  G  T  T  N  I  G  A  R  G  T  T  P  A  A  Q  A
       585            590            595           600            605
          1830      1840      1850      1860      1870      1880      1890
     ....|....|....|....|....|....|....|....|....|....|....|....|....|....|
     ctatccgttgatgtttggcaccccaaatcttgctgctcaaggtacaacaactccagcagttcagtcctat
        Y  P  L  M  F  G  T  P  N  L  A  A  Q  G  T  T  T  P  A  V  Q  S  Y
              610            615          620            625            630
          1900      1910      1920      1930      1940      1950      1960
     ....|....|....|....|....|....|....|....|....|....|....|....|....|....|
     cctacgatgtttggaacaccaaatctagctggtcaaagtacaacaacaactcgagcaggtcagccatatc
       P  T  M  F  G  T  P  N  L  A  G  Q  S  T  T  T  T  R  A  G  Q  P  Y
              635            640           645            650
          1970      1980      1990      2000      2010      2020      2030
     ....|....|....|....|....|....|....|....|....|....|....|....|....|....|
     ctacgacgtttgctgttcctcaagctgcgacagctccagcagttcagccgtatgctatgatgtttggtac
       P  T  T  F  A  V  P  Q  A  A  T  A  P  A  V  Q  P  Y  A  M  M  F  G  T
        655            660            665            670            675
          2040      2050      2060      2070      2080      2090      2100
     ....|....|....|....|....|....|....|....|....|....|....|....|....|....|
     accaagtctcggagctcaagatatcactccaggaggtcaagcctatcccgctcatggtttaactctccca
       P  S  L  G  A  Q  D  I  T  P  G  G  Q  A  Y  P  A  H  G  L  T  L  P
          680            685            690            695               700
          2110      2120
     ....|....|....|....
     ttcgccgccatgagtctgcagtaa  2124     (SEQ ID NO:32)
       F  A  A  M  S  L  Q  *         (SEQ ID NO:31)
              705
```

Fig. 10

Fig. 13  Gene 26 cDNA and Peptide

```
          10        20        30        40        50        60        70
....|....|....|....|....|....|....|....|....|....|....|....|....|....|
atgttggctagggtttgtggattcaagtgttcttcttctcctgctgagtctgcggctagattgttctgta
 M  L  A  R  V  C  G  F  K  C  S  S  S  P  A  E  S  A  A  R  L  F  C
           5                  10                 15                 20
          80        90       100       110       120       130       140
....|....|....|....|....|....|....|....|....|....|....|....|....|....|
cgagatcgattcgtgatactctggccaaggcaagcggagagagttgcgaagcaggttttggaggagagag
 T  R  S  I  R  D  T  L  A  K  A  S  G  E  S  C  E  A  G  F  G  G  E  S
       25                 30                 35                 40                45
         150       160       170       180       190       200       210
....|....|....|....|....|....|....|....|....|....|....|....|....|....|
tttgaagctgcaaagtgggtttcatgaaatcaaaggtttagaggatgcgattgatttgttcagtgacatg
   L  K  L  Q  S  G  F  H  E  I  K  G  L  E  D  A  I  D  L  F  S  D  M
      50                  55                 60                 65                 70
         220       230       240       250       260       270       280
....|....|....|....|....|....|....|....|....|....|....|....|....|....|
cttcgatctcgtcctttaccttctgtggttgatttctgtaaattgatgggtgtggtggtgagaatggaac
 L  R  S  R  P  L  P  S  V  V  D  F  C  K  L  M  G  V  V  V  R  M  E
              75                 80                 85                 90
         290       300       310       320       330       340       350
....|....|....|....|....|....|....|....|....|....|....|....|....|....|
gcccggatcttgtgatttctctctatcagaagatggaaaggaaacagattcgatgtgatatatacagctt
 R  P  D  L  V  I  S  L  Y  Q  K  M  E  R  K  Q  I  R  C  D  I  Y  S  F
    95                100                105                110                115
         360       370       380       390       400       410       420
....|....|....|....|....|....|....|....|....|....|....|....|....|....|
caatattctgataaaatgtttctgcagctgctctaagctcccctttgctttgtctacatttggtaagatc
  N  I  L  I  K  C  F  C  S  C  S  K  L  P  F  A  L  S  T  F  G  K  I
        120               125                130                135              140
         430       440       450       460       470       480       490
....|....|....|....|....|....|....|....|....|....|....|....|....|....|
accaagcttggactccaccctgatgttgttaccttcaccaccctgctccatggattatgtgtggaagata
  T  K  L  G  L  H  P  D  V  V  T  F  T  T  L  L  H  G  L  C  V  E  D
             145                150                155                160
         500       510       520       530       540       550       560
....|....|....|....|....|....|....|....|....|....|....|....|....|....|
gggtttctgaagccttggatttttttcatcaaatgtttgaaacgacatgtaggcccaatgtcgtaacctt
 R  V  S  E  A  L  D  F  F  H  Q  M  F  E  T  T  C  R  P  N  V  V  F
      165               170                175                180                185
         570       580       590       600       610       620       630
....|....|....|....|....|....|....|....|....|....|....|....|....|....|
caccactttgatgaacggtcttttgccgcgagggtagaattgtcgaagccgtagctctgcttgatcggatg
   T  T  L  M  N  G  L  C  R  E  G  R  I  V  E  A  V  A  L  L  D  R  M
        190                195                200                205              210
         640       650       660       670       680       690       700
....|....|....|....|....|....|....|....|....|....|....|....|....|....|
atggaagatggtctccagcctacccagattacttatggaacaatcgtagatgggatgtgtaagaagggag
  M  E  D  G  L  Q  P  T  Q  I  T  Y  G  T  I  V  D  G  M  C  K  K  G
            215                220                225                230
         710       720       730       740       750       760       770
....|....|....|....|....|....|....|....|....|....|....|....|....|....|
atactgtgtctgcactgaatctgctgaggaagatggaggaggtgagccacatcatacccaatgttgtaat
  D  T  V  S  A  L  N  L  L  R  K  M  E  E  V  S  H  I  I  P  N  V  V  I
     235                240                245                250              255
```

Fig. 13 Continued

```
          780       790       800       810       820       830       840
   ....|....|....|....|....|....|....|....|....|....|....|....|....|....|
   ctatagtgcaatcattgatagcctttgtaaagacggacgtcatagcgatgcacaaaatcttttcactgaa
      Y  S  A  I  I  D  S  L  C  K  D  G  R  H  S  D  A  Q  N  L  F  T  E
         260       265       270       275       280
          850       860       870       880       890       900       910
   ....|....|....|....|....|....|....|....|....|....|....|....|....|....|
   atgcaagagaaaggaatctttcccgatttatttacctacaacagtatgatagttggttttgtagctctg
      M  Q  E  K  G  I  F  P  D  L  F  T  Y  N  S  M  I  V  G  F  C  S  S
                285       290       295       300
          920       930       940       950       960       970       980
   ....|....|....|....|....|....|....|....|....|....|....|....|....|....|
   gtagatggagcgacgcggagcagttgttgcaagaaatgttagaaaggaagatcagccctgatgttgtaac
      G  R  W  S  D  A  E  Q  L  L  Q  E  M  L  E  R  K  I  S  P  D  V  V  T
         305       310       315       320       325
          990      1000      1010      1020      1030      1040      1050
   ....|....|....|....|....|....|....|....|....|....|....|....|....|....|
   ttataatgctttgatcaatgcatttgtcaaggaaggcaagttctttgaggctgaagaattatacgatgag
      Y  N  A  L  I  N  A  F  V  K  E  G  K  F  F  E  A  E  E  L  Y  D  E
         330       335       340       345       350
         1060      1070      1080      1090      1100      1110      1120
   ....|....|....|....|....|....|....|....|....|....|....|....|....|....|
   atgcttccaaggggtataatccctaatacaatcacatatagttcaatgatcgatggattttgcaaacaga
      M  L  P  R  G  I  I  P  N  T  I  T  Y  S  S  M  I  D  G  F  C  K  Q
             355       360       365       370
         1130      1140      1150      1160      1170      1180      1190
   ....|....|....|....|....|....|....|....|....|....|....|....|....|....|
   atcgtcttgatgctgctgagcacatgttttatttgatggctaccaagggctgctctcccaacctaatcac
      N  R  L  D  A  A  E  H  M  F  Y  L  M  A  T  K  G  C  S  P  N  L  I  T
         375       380       385       390       395
         1200      1210      1220      1230      1240      1250      1260
   ....|....|....|....|....|....|....|....|....|....|....|....|....|....|
   tttcaatactctcatagacggatattgtggggctaagaggatagatgatggaatggaacttctccatgag
      F  N  T  L  I  D  G  Y  C  G  A  K  R  I  D  D  G  M  E  L  L  H  E
         400       405       410       415       420
         1270      1280      1290      1300      1310      1320      1330
   ....|....|....|....|....|....|....|....|....|....|....|....|....|....|
   atgactgaaacaggattagttgctgacacaactacttacaacactcttattcacgggttctatctggtgg
      M  T  E  T  G  L  V  A  D  T  T  T  Y  N  T  L  I  H  G  F  Y  L  V
             425       430       435       440
         1340      1350      1360      1370      1380      1390      1400
   ....|....|....|....|....|....|....|....|....|....|....|....|....|....|
   gcgatcttaatgctgctctagacctttttacaagagatgatctctagtggtttgtgccctgatatcgttac
      G  D  L  N  A  A  L  D  L  L  Q  E  M  I  S  S  G  L  C  P  D  I  V  T
         445       450       455       460       465
         1410      1420      1430      1440      1450      1460      1470
   ....|....|....|....|....|....|....|....|....|....|....|....|....|....|
   ttgtgacactttgctggatggtctctgcgataatgggaaactaaaagatgcattggaaatgtttaaggtt
      C  D  T  L  L  D  G  L  C  D  N  G  K  L  K  D  A  L  E  M  F  K  V
         470       475       480       485       490
         1480      1490      1500      1510      1520      1530      1540
   ....|....|....|....|....|....|....|....|....|....|....|....|....|....|
   atgcagaagagtaagaaggatcttgatgctagtcaccccttcaatggtgtggaacctgatgttcaaactt
      M  Q  K  S  K  K  D  L  D  A  S  H  P  F  N  G  V  E  P  D  V  Q  T
             495       500       505       510
```

Fig. 13 Continued

```
         1550      1560      1570      1580      1590      1600      1610
     ....|....|....|....|....|....|....|....|....|....|....|....|....|....|
     acaatatattgatcagcggcttgatcaatgaagggaagttttagaggccgaggaattatacgaggagat
      Y  N  I  L  I  S  G  L  I  N  E  G  K  F  L  E  A  E  E  L  Y  E  E  M
       515            520            525            530            535
         1620      1630      1640      1650      1660      1670      1680
     ....|....|....|....|....|....|....|....|....|....|....|....|....|....|
     gccccacaggggtatagtcccagatactatcacctatagctcaatgatcgatggattatgcaagcagagc
       P  H  R  G  I  V  P  D  T  I  T  Y  S  S  M  I  D  G  L  C  K  Q  S
          540            545            550            555            560
         1690      1700      1710      1720      1730      1740      1750
     ....|....|....|....|....|....|....|....|....|....|....|....|....|....|
     cgcctagatgaggctacacaaatgtttgattcgatgggtagcaagagcttctctccaaacgtagtgacct
      R  L  D  E  A  T  Q  M  F  D  S  M  G  S  K  S  F  S  P  N  V  V  T
            565            570            575            580
         1760      1770      1780      1790      1800      1810      1820
     ....|....|....|....|....|....|....|....|....|....|....|....|....|....|
     ttactacactcattaatggctactgtaaggcaggaagggttgatgatgggctggagcttttctgcgagat
      F  T  T  L  I  N  G  Y  C  K  A  G  R  V  D  D  G  L  E  L  F  C  E  M
       585            590            595            600            605
         1830      1840      1850      1860      1870      1880      1890
     ....|....|....|....|....|....|....|....|....|....|....|....|....|....|
     gggtcgaagagggatagttgctaacgcaattacttacatcactttgatttgtggttttcgtaaagtggt
       G  R  R  G  I  V  A  N  A  I  T  Y  I  T  L  I  C  G  F  R  K  V  G
          610            615            620            625            630
         1900      1910      1920      1930      1940      1950      1960
     ....|....|....|....|....|....|....|....|....|....|....|....|....|....|
     aatattaatggggctctagacatttttccaggagatgatttcaagtggtgtgtatcctgataccattacca
      N  I  N  G  A  L  D  I  F  Q  E  M  I  S  S  G  V  Y  P  D  T  I  T
            635            640            645            650
         1970      1980      1990      2000      2010      2020      2030
     ....|....|....|....|....|....|....|....|....|....|....|....|....|....|
     tccgcaatatgctgactggtttatggagtaaagaggaactaaaaagggcagtggcaatgcttgagaaact
      I  R  N  M  L  T  G  L  W  S  K  E  E  L  K  R  A  V  A  M  L  E  K  L
       655            660            665            670            675
         2040      2050      2060      2070      2080      2090      2100
     ....|....|....|....|....|....|....|....|....|....|....|....|....|....|
     gcagatgagtatggtatgtaagtttctgttcagtctatgtatttttatataaacaagaatgtatacatt
       Q  M  S  M  V  C  K  F  L  F  S  L  C  I  F  Y  I  N  K  N  V  Y  I
          680            685            690            695            700
         2110      2120
     ....|....|....|....|....
     cttttgtgtgtagcttcagattga  2124     (SEQ ID NO:89)
      L  L  C  V  A  S  D  *           (SEQ ID NO:88)
            705
```

NUCLEAR FERTILITY RESTORER GENES AND METHODS OF USE IN PLANTS

CROSS-REFERENCE TO RELATED APPLICATIONS

This application claims the priority benefit of U.S. Provisional Patent Application Ser. No. 60/305,026 filed Jul. 12, 2001, U.S. Provisional Patent Application Ser. No. 60/305,363 filed Jul. 13, 2001, and U.S. Provisional Patent Application Ser. No. 60/308,736 filed Jul. 30, 2001, the entire contents of which are hereby incorporated by reference.

BACKGROUND OF THE INVENTION

1 Field of the Invention

This invention relates generally to nucleic acid sequences encoding proteins that restore fertility in a plant.

2 Background Art

Considerable effort is being devoted to the development of strategies to increase canola yields due to the importance of canola crops worldwide. One method of obtaining increased yields of canola involves the generation of hybrid canola plants. Due to a phenomenon termed "hybrid vigor" hybrid canola plants are higher yielding than non-hybrid canola plants (Grant, I. and Beversdorf, W., 1985, Can. J. Genet. Cytol. 27:472–478). In fact, manually produced hybrids can yield up to 50% more seed than either of their parental lines. To produce such hybrids on a large scale, however, self-pollination of at least one of the parents of the hybrid cross must be prevented. One means of preventing self-pollination is to incorporate the trait of cytoplasmic male sterility into a seed parent of the hybrid.

Cytoplasmic male sterility (CMS) results in an inability of the plant to produce viable pollen. In some cases, pollen formation is blocked or aborted in a CMS plant because of a gene in a cytoplasmic organelle, the mitochondrion. This widespread and classic non-Mendelian trait results from rearrangements of the mitochondrial genome (Schnable, P. S. and Wise, R. P., 1998, Trends in Plant Sci., 3:175–180). Plants carrying the CMS trait are incapable of self-pollination, and therefore, when a CMS line is planted alongside a male-fertile line, all the seed that forms on the sterile plants is a hybrid of the two parents.

Importantly however, use of the CMS trait in a hybridization scheme produces seeds that are male-sterile since, in most species, the trait is inherited maternally. While the fertility of the resultant seeds is unimportant in some crops (i.e., vegetables), fertility must be restored in the crops for which pollen production is required for formation of the harvested products, as in the case of fruit or seed crops such as canola. In order to restore fertility to the hybrids, specific dominant nuclear genes termed restorers of fertility (Rf) can be introduced into the hybrid plants to suppress the male-sterile phenotype (Schnable, P. S. and Wise, R. P., 1998, Trends in Plant Sci., 3:175–180). Accordingly, the use of CMS for commercial seed production involves the use of three breeding lines, a male-sterile line (female parent), a maintainer line which is isogenic to the male-sterile line but does not contain a sterility inducing mitochondrial genome and a restorer line (male parent).

A crop of particular interest herein is the oilseed crop of the species *Brassica napus*, commonly referred to as canola. A number of CMS systems have been reported in Brassica species. Five of the systems most commonly used for hybrid seed production are Polima (pol), nap, tournefortii, Kosena and Ogura (ogu). The form of CMS in *Brassica napus* which is currently thought to be potentially the most useful for hybrid seed production is the ogu system. The ogu system is based on the use of a hybrid cytoplasm in which the male sterility determinant is derived from a radish (*Raphanus sativum*) cytoplasm. Male sterility induced by ogu cytoplasm is more complete and more temperature stable than any of the other endogenous *B. napus* CMS systems. Analysis of the ogu mitochondrial genome has indicated that this form of CMS is specified by a novel open reading frame (ORF), orf138, that encodes a polypeptide, ORF138 (Grelon et al., 1994, Mol. Gen. Genet. 243:540–547).

Recently, a *Brassica napus* restorer line for the ogu system became available (Delourme, R. et al., 1995, Proc. 9$^{th}$ Int. Rapeseed Cong. Cambridge, UK 1:6–8). Using this restorer line, it was determined that restoration of fertility resulted in a decrease of the ORF138 protein in stamens as compared to un-restored, ogu sterile lines (Bellaui, M. et al., 1999, Plant Mol. Biol. 40:893–902). However, a drawback to these prior art ogu restorer lines is that hybrids produced using these lines have elevated glucosinolate levels. An elevation of glucosinolate levels in plants is problematic when the plants are used in animal feed because this compound causes digestive problems in animals. Elevated glucosinolate levels are undesirable in canola plants in particular since much of their value is derived from their low levels of glucosinolate compounds.

The elevation of glucosinolate levels results from a dominant gene that is linked to the radish nuclear fertility restorer gene or genes, termed Rfo in the prior art. Rfo, like the ogu cytoplasm, has been introduced from the radish but recombination in the radish chromosomal region surrounding Rfo is suppressed in *B. napus* (Delourme R. et al., 1998, Theor. Appl. Genet. 97:129–134). Despite considerable effort by several groups, it has not yet been possible to develop stable *B. napus* lines in which Rfo has been efficiently dissociated from the glucosinolate gene and do not address other deficiencies in Rfo restorer lines, and therefore, the system is not widely implemented.

Accordingly, what are needed in the art are improved lines of canola that can be used as restorers of fertility in hybridization systems. More particularly, it would be beneficial to provide restorer lines of canola containing one or more nuclear fertility restorer genes from *Raphanus sativum*, which genes are separated from the gene or genes causing increased levels of glucosinolate in the resultant hybrid plants. The present invention also provides a method of using the fertility restorer nucleic acid to select for transgenic plant cells by means of its capacity to restore pollen production to cytoplasmic male sterile plants.

SUMMARY OF THE INVENTION

This invention fulfills in part the need to isolate a nuclear fertility restorer locus and genes and provide improved restorer lines for plants, and canola in particular. The present invention provides a Rfo restorer region that contains a genus of isolated nuclear fertility restorer genes. In one embodiment, the nuclear fertility restorer genus is derived from a radish, comprises a pentatricopeptide (PPR) motif and is able to restore fertility in a male-sterile plant. In another preferred embodiment, the nuclear fertility restorer genus is lacking genes associated with increased glucosinolate traits. In a preferred embodiment, the male-sterile plant comprises the ogu male sterility determinant and the nuclear fertility restorer gene is derived from *Raphanus sativum*. In a more preferred embodiment, the male-sterile plant is *Brassica napus*.

The present invention provides a nuclear fertility restorer genus as shown in SEQ ID NO:87. In a preferred embodiment, the present invention provides a nuclear fertility restorer genus, located within Genes 14 through 30, as shown between positions 88,073 and 198,041 of SEQ ID NO:87. In a preferred embodiment, the nuclear fertility restorer gene is selected from Genes 15, 16, 17, 21, 22, 24, 26 and 27, as defined herein. In a preferred embodiment, the nuclear fertility restorer gene is a nucleotide sequence selected from SEQ ID NO:30, SEQ ID NO:32, SEQ ID NO:34, SEQ ID NO:42, SEQ ID NO:44, SEQ ID NO:48 SEQ ID NO:52, SEQ ID NO:54 and SEQ ID NO:89. In a preferred embodiment, the nuclear fertility restorer gene encodes a protein comprising an amino acid sequence of Gene product 15, 16, 17, 21, 22, 24, 26 and 27, as defined herein. In a preferred embodiment, the nuclear fertility restorer gene encodes a protein comprising an amino acid sequence selected from SEQ ID NO:29, SEQ ID NO:31, SEQ ID NO:33, SEQ ID NO:41, SEQ ID NO:43, SEQ ID NO:47, SEQ ID NO:51, SEQ ID NO:53 and SEQ ID NO:88. In a preferred embodiment, the nuclear fertility restorer gene comprises a nucleotide sequence of Gene 16 as shown in SEQ ID NO:32 or Gene 26 as shown in SEQ ID NO:89. In a preferred embodiment, the nuclear fertility restorer gene encodes a protein comprising an amino acid sequence as shown in SEQ ID NO:31 or SEQ ID NO:88.

The invention further provides an isolated plant transformation vector comprising a nuclear fertility restorer gene as described below, wherein expression of the vector in a host plant results in the plant's increased production of viable pollen. In a preferred embodiment, the host cells are located in a plant stamen, or more particularly, a plant anther.

The present invention also provides plant cells, plant parts, plant seeds and plants comprising the nuclear fertility restorer genes, proteins and vectors described herein. In one embodiment, a plant seed according to the present invention comprises a nuclear fertility restorer nucleic acid, and accordingly, the plant seed is true breeding for the ability to restore fertility in a male-sterile plant. The invention further provides an agricultural product produced by any of the below-described plants, plant parts or plant seeds.

The invention additionally provides a method of producing a hybrid plant comprising crossing a male-sterile plant with a restorer plant, wherein the restorer plant contains a nuclear fertility restorer nucleic acid described herein. The present invention also provides a method of restoring male fertility in a plant comprising introducing a nuclear fertility restorer nucleic acid into a male-sterile plant. The present invention also provides a method of increasing the production of viable pollen in a plant, including introducing a nuclear fertility restorer nucleic acid into a plant. The present invention also provides methods of using genetic markers from the sequences described herein to determine the presence of a nuclear fertility restorer genus in a plant.

BRIEF DESCRIPTION OF THE DRAWINGS

FIG. 3A. Representation of radish genetic maps in the Rfo region based on genetic mapping of *Arabidopsis* BAC-derived probes (map positions are indicated by dots on the solid lines; only two of the mapped makers, L12 and L40, are labeled). The lower bar represents the position of the same markers on the Physical map of the *Arabidopsis* genome. The lines between the two bars indicate the relationship between the physical position of the markers in *Arabidopsis* and the genetic position in radish. Note the duplication (rB1 and rB2) and inversion (rB2) of *Arabidopsis* region B in the radish genetic map. FIG. 3B. Proposed physical relationship between the *Arabidopsis* and radish genomes in the Rfo region. The inversion of markers in the rB2 region of radish with respect to *Arabidopsis* suggest that the Rfo gene can be approached by employing *Arabidopsis*-derived markers from region A moving from positions c to a.

FIG. 9 Structure of the protein encoded by Gene 16 (Gene 16p), as deduced from the sequence of the full length cDNA.

FIG. 10. Comparisons of the proteins encoded by Gene 16 (Gene 16p) and Gene 15 (Gene 15p). Identical amino acids are indicated by dark shading. Sites at which an amino acid is replaced by a similar but non-identical amino acid are indicated by lighter shading.

FIG. 13. Structural features of the protein encoded by Gene 26 (Gene 26p). The predicted N terminal mitochondrial targeting presequence is enclosed in the open boxes. Shaded regions indicate copies of the PPR domain repeats.

DETAILED DESCRIPTION OF THE INVENTION

Figure 1:
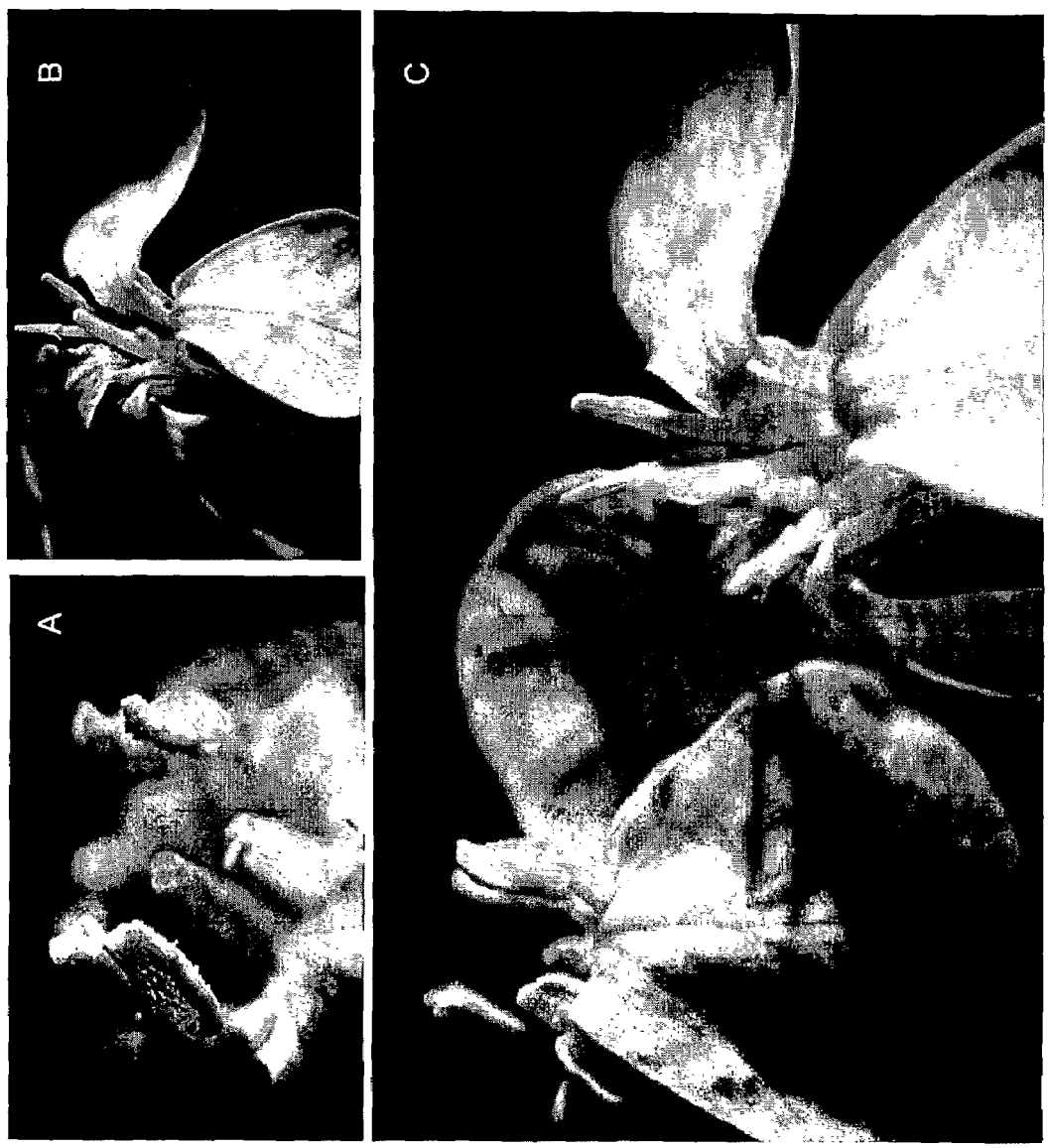
FIG. 1. Flowers of Rfo-fertility restored (A) and Ogura (ogu) cytoplasmic male sterile radish (*Raphanus sativum*) (B). Panel C allows direct comparison of fertility restored (left) and ogu CMS floral morphology.

The present invention may be understood more readily by reference to the following detailed description of the preferred embodiments of the invention and the Examples included herein. However, before the present compounds, compositions, and methods are disclosed and described, it is to be understood that this invention is not limited to specific nucleic acids, specific polypeptides, specific cell types, specific host cells, specific conditions, or specific methods, etc., as such may, of course, vary, and the numerous modifications and variations therein will be apparent to those skilled in the art. It is also to be understood that the terminology used herein is for the purpose of describing specific embodiments only and is not intended to be limiting.

This invention fulfills in part the need to isolate a nuclear fertility restorer locus and genes and provide improved restorer lines for plants, and canola in particular. The present invention provides a Rfo restorer region that contains a genus of isolated nuclear fertility restorer genes. In one embodiment, the nuclear fertility restorer genus is derived from a radish, comprises pentatricopeptide (PPR) motifs and is able to restore fertility in a male-sterile plant. In another preferred embodiment, the nuclear fertility restorer genus is lacking genes associated with increased glucosinolate traits. In a preferred embodiment, the male-sterile plant comprises the ogu male sterility determinant and the nuclear fertility restorer gene is derived from *Raphanus sativum*. In a more preferred embodiment, the male-sterile plant is *Brassica napus*.

The present invention provides a nuclear fertility restorer genus as shown in SEQ ID NO:87. In a preferred embodiment, the present invention provides a nuclear fertility restorer genus, located within Genes 14 through 30 as defined herein, as shown between positions 88,073 and 198,041 of SEQ ID NO:87. In a preferred embodiment, the nuclear fertility restorer gene is selected from Genes 15, 16, 17, 21, 22, 24, 26 and 27, as defined herein. In a preferred embodiment, the nuclear fertility restorer gene is a nucleotide sequence selected from SEQ ID NO:30, SEQ ID NO:32, SEQ ID NO:34, SEQ ID NO:42, SEQ ID NO:44, SEQ ID NO:48, SEQ ID NO:52, SEQ ID NO:54 and SEQ ID NO:89. In a preferred embodiment, the nuclear fertility restorer gene encodes a protein comprising an amino acid sequence of Gene product 15, 16, 17, 21, 22, 24, 26 and 27, as defined herein. In a preferred embodiment, the nuclear fertility restorer gene encodes a protein comprising an amino acid sequence selected from SEQ ID NO:29, SEQ ID NO:31, SEQ ID NO:33, SEQ ID NO:41, SEQ ID NO:43, SEQ ID NO:47, SEQ ID NO:51, SEQ ID NO:53 and SEQ ID NO:88. In a preferred embodiment, the nuclear fertility restorer gene encodes a protein comprising an amino acid sequence as shown in SEQ ID NO:31 or SEQ ID NO:88.

The invention further provides an isolated plant transformation vector comprising a nuclear fertility restorer gene as described below, wherein expression of the vector in a host plant results in the plant's increased production of viable pollen. In a preferred embodiment, the host cells are located in a plant stamen, or more particularly, a plant anther.

The present invention also provides plant cells, plant parts, plant seeds and plants comprising the nuclear fertility restorer genes, proteins and vectors described herein. In one embodiment, a plant seed according to the present invention comprises a nuclear fertility restorer nucleic acid, and accordingly, the plant seed is true breeding for the ability to restore fertility in a male-sterile plant. The invention further provides an agricultural product produced by any of the below-described plants, plant parts or plant seeds.

The invention additionally provides a method of producing a hybrid plant comprising crossing a male-sterile plant with a restorer plant, wherein the restorer plant contains a nuclear fertility restorer nucleic acid described herein. The present invention also provides a method of restoring male fertility in a plant comprising introducing a nuclear fertility restorer nucleic acid into a male-sterile plant. The present invention also provides a method of increasing the production of viable pollen in a plant, including introducing a nuclear fertility restorer nucleic acid into a plant. The present invention also provides methods of using genetic markers from the sequences described herein to determine the presence of a nuclear fertility restorer genus in a plant.

A novel discovery described herein comprises the identification of the nucleic acid sequence that encodes the Rfo genetic locus in *Raphanus sativum* associated with restoration of fertility in male-sterile plants. It is to be understood that the Rfo genetic locus includes one or more introns, one or more exons, or a combination thereof.

The present invention provides in a preferred embodiment specific genes from the genomic DNA of a radish Ogura restorer line. Each of these genes can, individually, completely restore male fertility to CMS lines carrying the Ogura cytoplasm. The genes each encode apparently unrelated proteins. The availability of the isolated genes makes it possible to produce a restorer line by introducing the isolated gene or genes into *B. napus* plants for example by plant transformation. The resulting plants carry reduced agronomic deficiencies associated with the presence of Rfo-region radish DNA in *B. napus*, including the gene that elevates seed glucosinolate content. This method for producing *B. napus* restorer lines for ogu CMS is faster and less costly than any other currently known practice.

While the genes of the present invention that restore ogu CMS bear no resemblance to the other restorer genes that have been characterized at the DNA or protein sequence levels, the invention provides that nuclear restorer genes for other CMS systems in other crops can be homologs of the radish Rfo genes. Thus, the knowledge of the molecular identity of the Rfo genes presented herein allows the facile isolation of nuclear restorers for many other crop species in which CMS is employed in hybrid production, such as sunflower and rice.

The examples herein provide evidence that multiple specific genes within the sequence listed in the Appendix as SEQ ID NO:87 can function as fertility restorer genes. Specifically, Gene 16 (SEQ ID NO:32) and Gene 26 (SEQ ID NO:89) are demonstrated to restore fertility in a CMS system. The invention provides that other genes within the region can also function as restorer genes. For example, two partially fertile plants were obtained after transformation with the Gene 15 (SEQ ID NO:30) construct. Thus Gene 15, like Gene 16, can function as a restorer gene. Similarly, two partially fertile plants were recovered after transformation with the Gene 17 (SEQ ID NO:34) construct. A plant transformed with a construct containing Gene 21 (SEQ ID NO:42) and Gene 22 (SEQ ID NO:44) also produced some fertile flowers. Gene 24 (SEQ ID NO:48) and Gene 27 (SEQ ID NO:54) also contain PPR domains and are therefore expected to restore fertility phenotype according to the present invention. As discussed above, the preliminary analysis indicated that the restorer functions are most preferably located between Gene 14 and Gene 30 within the Rfo region as shown in the Appendix between positions 88,073 and 198,041 of SEQ ID NO:87.

There are several reasons why not all of the transformants recovered following transformation with a specific construct necessarily show the same phenotype. The expression of the genes encoded in a specific construct may vary depending on the site of insertion, the number of copies of the gene at each insertion site, and other factors such as transgene silencing. Therefore, it is apparent that other genes in the genetically defined Rfo containing region will likely be found by routine analysis in view of the present disclosure to function as genes that confer complete fertility restoration. Given that Rfo maps as a single genetic locus in radish, the invention provides that two or more different genes in the region are able to function as restorer genes for Ogura CMS in *B. napus*.

The sequences given in the Appendix have utility in the development of effective, glucosinolate-free or glucosinolate-reduced restorer lines through approaches other than the transgenic approach illustrated above. In one envisioned example of this embodiment, any portion of the sequence can be used to design DNA markers that allow the radish Rfo region to be specifically detected in plant breeding experiments aimed at separating the high seed glucosinolate trait from the restorer gene. Such markers allow the identification of individual plants that contain the restorer gene region but have a minimal amount of associated radish DNA. This in turn aids significantly in the development of alternative low glucosinolate Ogura restorer lines.

As mentioned above, the present invention provides a genus of isolated Rfo genes and proteins encoded thereby. Some members include a pentatricopeptide (PPR) motif, or consensus sequence, and are able to restore fertility in a male-sterile plant. As used herein, "PPR motif" includes the following amino acid consensus sequence: VTYNTLISGY-CKAGKLEEALELFKEMKEKGIKPDV (SEQ ID NO:90). A Rfo protein is defined herein as a protein whose amino acid sequence has one or more 35 amino acid regions having greater than 50% homology with a PPR motif or consensus sequence, and preferably comprises at least the single methionine and the tyrosine at position three of the motif. As also used herein, the term "male-sterile plant" refers to a plant wherein the function of the male organs is disrupted or blocked, or more particularly, wherein the male organs are unable to produce viable pollen. The term "male-sterile" includes genetic male sterility and cytoplasmic-genetic male sterility. The terms "cytoplasmic-genetic male sterile" and "cytoplasmic male sterile" are used interchangeably herein. In a preferred embodiment, the nucleic acids and proteins of the present invention are used to restore fertility in a cytoplasmic male-sterile, or CMS, plant. In a further preferred embodiment, the cytoplasmic male-sterile plant comprises a cytoplasmic male sterility determinant selected from the group consisting of pol, nap, Tournefortii, Kosena and ogu. In a most preferred embodiment, the cytoplasmic male sterility determinant is ogu.

The male-sterile plants of the present invention can be selected from maize, wheat, rye, oat, triticale, rice, barley, soybean, peanut, rapeseed, canola, pepper, sunflower, Vicia species, pea, alfalfa, bushy plants (coffee, cacao, tea), Salix species, radish, sorghum, pearl millet, cotton, and tobacco. It is preferable however that the male-sterile plant is a canola plant selected from the group of *Brassica* species consisting of *Brassica napus, Brassica rapa* (or *campestris*), *Brassica oleracea, Brassica nigra, Brassica juncea, Sinapis alba,* and *Brassica carinata*. In a more preferred embodiment, the male-sterile plant is *Brassica napus*.

The present invention encompasses a Rfo gene derived from a species of radish, including but not limited to, *Raphanus sativum*. In one embodiment of the present invention, the Rfo gene is derived from *Raphanus sativum*. Accordingly, the present invention provides a Rfo gene that, upon its introduction into a male-sterile plant, is able to increase the plant's production of pollen and/or restore the fertility of the plant.

The invention further includes isolated amino acid sequences encoded by the Rfo genes provided herein. In a preferred embodiment, the nuclear fertility restorer protein (hereinafter "Rf protein" or "Rf amino acid sequence") comprises an amino acid sequence as shown herein. The present invention also includes homologs, orthologs and paralogs of the amino acid sequences shown herein. Homologs, orthologs and paralogs are further defined below.

The terms "gene", "nucleic acid" and "nucleic acid molecule" are used interchangeably herein and are intended to include DNA molecules (e.g., cDNA or genomic DNA) and RNA molecules (e.g., mRNA) and analogs of the DNA or RNA generated using nucleotide analogs. This term also encompasses untranslated sequence located at both the 3' and 5' ends of the coding region of the gene: up to at least about 1000 nucleotides of sequence upstream from the 5' end of the coding region and up to at least about 200 nucleotides of sequence downstream from the 3' end of the coding region of the gene. The nucleic acid molecule can be single-stranded or double-stranded, but preferably is double-stranded DNA.

An "isolated" nucleic acid molecule is one that is substantially separated from other nucleic acid molecules that are present in the natural source of the nucleic acid (i.e., sequences encoding other proteins). Preferably, an "isolated" nucleic acid is free of some of the sequences that naturally flank the nucleic acid (i.e., sequences located at the 5' and 3' ends of the nucleic acid) in its naturally occurring replicon. For example, a cloned nucleic acid is considered isolated. In one embodiment of the present invention, a Rfo nucleic acid is isolated when it is separated from all or part of the glucosinolate gene, for example in *Raphanus sativum*. In other various embodiments, the isolated Rfo nucleic acid molecule can contain less than about 5 kb, 4 kb, 3 kb, 2 kb, 1 kb, 0.5 kb or 0.1 kb of nucleotide sequences which naturally flank the nucleic acid molecule in genomic DNA of the cell from which the nucleic acid is derived (e.g., a *Raphanus sativum* cell). A nucleic acid is also considered isolated if it has been altered by human intervention, or placed in a locus or location that is not its natural site, or if it is introduced into a cell by *Agrobacterium*-mediated transformation. Moreover, an "isolated" nucleic acid molecule, such as a cDNA molecule, can be free from some of the other cellular material with which it is naturally associated, or culture medium when produced by recombinant techniques, or chemical precursors or other chemicals when chemically synthesized.

Specifically excluded from the definition of "isolated nucleic acids" are: naturally-occurring chromosomes (such as chromosome spreads), artificial chromosome libraries, genomic libraries, and cDNA libraries that exist either as an in vitro nucleic acid preparations or as a transfected/transformed host cell preparation, wherein the host cells are either an in vitro heterogeneous preparation or plated as a heterogeneous population of single colonies. Also specifically excluded are the above libraries wherein a specified nucleic acid makes up less than 5% of the number of nucleic acid inserts in the vector molecules. Further specifically excluded are whole cell genomic DNA or whole cell RNA preparations (including whole cell preparations that are mechanically sheared or enzymatically digested). Even further specifically excluded are the whole cell preparations found as either an in vitro preparation or as a heterogeneous mixture separated by electrophoresis wherein the nucleic acid of the invention has not further been separated from the heterologous nucleic acids in the electrophoresis medium (e.g., further separating by excising a single band from a heterogeneous band population in an agarose gel or nylon blot).

A nucleic acid molecule of the present invention, or a portion thereof, can be isolated using standard molecular biology techniques and the sequence information provided herein. For example, a Rfo cDNA can be isolated from a *Raphanus sativum* library using all or a portion of the sequence herein. Moreover, a nucleic acid molecule encompassing all or a portion of sequence herein can be isolated by the polymerase chain reaction using oligonucleotide primers designed based upon this sequence. For example, mRNA can be isolated from radish cells (e.g., by the guanidinium-thiocyanate extraction procedure of Chirgwin et al., 1979 Biochemistry 18:5294–5299) and cDNA can be prepared using reverse transcriptase (e.g., Moloney MLV reverse transcriptase, available from Gibco/BRL, Bethesda, Md.; or AMV reverse transcriptase, available from Seikagaku America, Inc., St. Petersburg, Fla.). Synthetic oligonucleotide primers for polymerase chain reaction amplification can be designed based upon the nucleotide sequence shown herein. A nucleic acid molecule of the invention can be amplified using cDNA or, alternatively, genomic DNA, as a template and appropriate oligonucleotide primers according to standard PCR amplification techniques. The nucleic acid molecule so amplified can be cloned into an appropriate vector and characterized by DNA sequence analysis. Furthermore, oligonucleotides corresponding to a Rfo nucleotide sequence can be prepared by standard synthetic techniques, e.g., using an automated DNA synthesizer.

In a preferred embodiment, an isolated nucleic acid molecule of the invention comprises one of the nucleotide sequences shown herein. It is to be understood that sequences shown herein comprise whole genomic fragments isolated from genomic DNA. Accordingly, SEQ ID NO:87, for example contains both coding regions and 5' and 3' untranslated regions that can include promoters and other regulatory sequences. Alternatively, the nucleic acid molecules of the present invention can comprise only the coding region of SEQ ID NO:87. A coding region of these sequences is indicated as an "ORF position". The present invention also includes Rfo coding nucleic acids that encode Rfo proteins as described herein.

Moreover, the nucleic acid molecule of the invention can comprise only a portion of the coding region of the sequences shown herein, for example, a fragment which can be used as a probe or primer or a fragment encoding a biologically active portion of a Rfo protein. The nucleotide sequences determined from the cloning of the Rfo genes from *Raphanus sativum* allow for the generation of probes and primers designed for use in identifying and/or cloning Rfo homologs in other cell types and organisms, as well as Rfo homologs from other radishes and related species.

Portions of proteins encoded by the Rfo nucleic acid molecules of the invention are preferably biologically active portions of one of the Rfo proteins described herein. As used herein, the term "biologically active portion of" a Rfo protein is intended to include a portion, e.g., a domain/motif, of a Rfo that participates in the restoration of fertility in a cytoplasmic male-sterile plant. In a preferred embodiment, the biologically active portion of a Rfo protein comprises one or more PPR motifs as described above. To determine whether a Rfo protein, or a biologically active portion thereof, can restore fertility in a cytoplasmic male-sterile plant, a fertility analysis of a plant comprising the Rfo protein may be performed. Such analysis methods are well known to those skilled in the art. More specifically, nucleic acid fragments encoding biologically active portions of a Rfo protein can be prepared by isolating a portion of sequences shown herein, introducing the isolated portion of nucleic acid into a male-sterile plant and assessing whether male-fertility is restored. A determination as to whether male-fertility is restored in a plant can be made, for example, by 1) visually assessing an increase in the production of pollen as compared to a male-sterile plant or 2) determining that the plant can self-fertilize as evidenced by placing a bag over a flower on the plant and finding an increase of seed therein as compared to a male-sterile plant. It is to be understood that a male-sterile plant containing an ogu cytoplasmic male sterility determinant can produce a small amount of pollen. In one embodiment of the present invention, restoration of fertility in a male-sterile plant is indicated by an increase in the plant's pollen production by at least 95%.

Biologically active portions of a Rfo proteins are encompassed by the present invention and include peptides comprising amino acid sequences derived from the amino acid sequence of a Rfo protein, or the amino acid sequence of a protein homologous to a Rfo protein, which includes fewer amino acids than a full length Rfo protein or the full length protein which is homologous to a Rfo protein, and exhibit at least one activity of a Rfo protein. Typically, biologically active portions (e.g., peptides which are, for example, 5, 10, 15, 20, 30, 35, 36, 37, 38, 39, 40, 50, 100 or more amino acids in length) comprise a domain or motif with at least one activity of a Rfo protein. Moreover, other biologically active portions in which other regions of the protein are deleted, can be prepared by recombinant techniques and evaluated for one or more of the activities described herein. Preferably, the biologically active portions of a Rfo protein include one or more PPR domains/motifs or portions thereof and are able to restore fertility in a cytoplasmic male-sterile plant.

The invention also provides Rfo chimeric or fusion proteins. As used herein, a Rfo "chimeric protein" or "fusion protein" comprises a Rfo polypeptide operatively linked to a non-Rfo polypeptide. A Rfo polypeptide refers to a polypeptide having an amino acid sequence corresponding to a Rfo protein, whereas a non-Rfo polypeptide refers to a polypeptide having an amino acid sequence corresponding to a protein which is not substantially homologous to the Rfo, e.g., a protein that is different from the Rfo and is derived from the same or a different organism. Within the fusion protein, the term "operatively linked" is intended to indicate that the Rfo polypeptide and the non-Rfo polypeptide are fused to each other so that both sequences fulfill the proposed function attributed to the sequence used. The non-Rfo polypeptide can be fused to the N-terminus or C-terminus of the Rfo polypeptide. For example, in one embodiment, the fusion protein is a GST-Rfo fusion protein in which the Rfo sequences are fused to the C-terminus of the GST sequences. Such fusion proteins can facilitate the purification of recombinant Rfo proteins. In another embodiment, the fusion protein is a Rfo protein containing a heterologous signal sequence at its N-terminus.

Preferably, a Rfo chimeric or fusion protein of the invention is produced by standard recombinant DNA techniques. For example, DNA fragments coding for the different polypeptide sequences are ligated together in-frame in accordance with conventional techniques, for example by employing blunt-ended or stagger-ended termini for ligation, restriction enzyme digestion to provide for appropriate termini, filling-in of cohesive ends as appropriate, alkaline phosphatase treatment to avoid undesirable joining and enzymatic ligation. In another embodiment, the fusion gene can be synthesized by conventional techniques including automated DNA synthesizers. Alternatively, PCR amplification of gene fragments can be carried out using anchor primers that give rise to complementary overhangs between two consecutive gene fragments which can subsequently be annealed and re-amplified to generate a chimeric gene sequence (see, for example, Current Protocols in Molecular Biology, Eds. Ausubel et al. John Wiley & Sons: 1992). Moreover, many expression vectors are commercially available that already encode a fusion moiety (e.g., a GST polypeptide). A Rfo encoding nucleic acid can be cloned into such an expression vector such that the fusion moiety is linked in-frame to the Rfo protein.

In addition to fragments and fusion proteins of the Rfo proteins described herein, the present invention includes homologs and analogs of naturally occurring Rfo proteins and Rfo encoding nucleic acids in a plant. "Homologs" are defined herein as two nucleic acids or proteins that have similar, or "homologous" nucleotide or amino acid sequences, respectively. Homologs include allelic variants, orthologs, paralogs, agonists and antagonists of Rfos as defined hereafter. The term "homolog" further encompasses nucleic acid molecules that differ from the nucleotide sequence shown herein (and portions thereof) due to degeneracy of the genetic code and thus encode the same Rfo protein as that encoded by the nucleotide sequences shown herein. As used herein a "naturally occurring" Rfo protein refers to a Rfo amino acid sequence that occurs in nature.

Nucleic acid molecules corresponding to natural homologs such as allelic variants, orthologs and paralogs and natural analogs of a Rfo cDNA can be isolated based on their identity to the *Raphanus sativum* Rfo nucleic acids described herein. These natural homologs and analogs can be isolated using Rfo cDNAs, or a portion thereof, as a hybridization probe according to standard hybridization techniques under stringent hybridization conditions. In an alternative embodiment, homologs of the Rfo protein can be identified by screening combinatorial libraries of mutants, e.g., truncation mutants, of the Rfo nucleic acids for Rfo protein agonist or antagonist activity. In one embodiment, a variegated library of Rfo variants is generated by combinatorial mutagenesis at the nucleic acid level and is encoded by a variegated gene library. A variegated library of Rfo variants can be produced by, for example, enzymatically ligating a mixture of synthetic oligonucleotides into gene sequences such that a degenerate set of potential Rfo sequences is expressible as individual polypeptides, or alternatively, as a set of larger fusion proteins (e.g., for phage display) containing the set of Rfo sequences therein. There are a variety of methods that can be used to produce libraries of potential Rfo homologs from a degenerate oligonucleotide sequence. Chemical synthesis of a degenerate gene sequence can be performed in an automatic DNA synthesizer, and the synthetic gene is then ligated into an appropriate expression vector. Use of a degenerate set of genes allows for the provision, in one mixture, of all of the sequences encoding the desired set of potential Rfo sequences. Methods for synthesizing degenerate oligonucleotides are known in the art (see, e.g., Narang, S. A., 1983 Tetrahedron 39:3; Itakura et al., 1984 Annu. Rev. Biochem. 53:323; Itakura et al., 1984 Science 198:1056; Ike et al., 1983 Nucleic Acid Res. 11:477).

In addition, libraries of fragments of the Rfo coding regions can be used to generate a variegated population of Rfo fragments for screening and subsequent selection of homologs of a Rfo. In one embodiment, a library of coding sequence fragments can be generated by treating a double stranded PCR fragment of a Rfo coding sequence with a nuclease under conditions wherein nicking occurs only about once per molecule, denaturing the double stranded DNA, renaturing the DNA to form double stranded DNA, which can include sense/antisense pairs from different nicked products, removing single stranded portions from reformed duplexes by treatment with S1 nuclease, and ligating the resulting fragment library into an expression vector. By this method, an expression library can be derived which encodes N-terminal, C-terminal and internal fragments of various sizes of the Rfo proteins.

Several techniques are known in the art for screening gene products of combinatorial libraries made by point mutations or truncation, and for screening cDNA libraries for gene products having a selected property. Such techniques are adaptable for rapid screening of the gene libraries generated by the combinatorial mutagenesis of Rfo homologs. The most widely used techniques, which are amenable to high through-put analysis, for screening large gene libraries typically include cloning the gene library into replicable expression vectors, transforming appropriate cells with the resulting library of vectors, and expressing the combinatorial genes under conditions in which detection of a desired activity facilitates isolation of the vector encoding the gene whose product was detected. Recursive ensemble mutagenesis (REM), a new technique that enhances the frequency of functional mutants in the libraries, can be used in combination with the screening assays to identify Rfo homologs (Arkin and Yourvan, 1992 PNAS 89:7811–7815; Delgrave et al., 1993 Protein Engineering 6(3):327–331). In another embodiment, cell based assays can be exploited to analyze a variegated Rfo library, using methods well known in the art. The present invention further provides a method of identifying a novel Rfo protein, comprising (a) raising a specific antibody response to a Rfo protein, or a fragment thereof, as described above; (b) screening putative Rfo protein material with the antibody, wherein specific binding of the antibody to the material indicates the presence of a potentially novel Rfo protein; and (c) analyzing the bound material in comparison to known Rfo proteins, to determine its novelty.

Preferably, the above described Rfo homologs retain the same biological activity as the Rfo proteins shown herein, and more preferably, the Rfo homologs restore fertility in a cytoplasmic male-sterile plant. To determine the percent homology of two amino acid sequences, the sequences are aligned for optimal comparison purposes (e.g., gaps can be introduced in the sequence of one protein for optimal alignment with the other protein). The amino acid residues at corresponding amino acid positions are then compared. When a position in one sequence is occupied by the same amino acid residue as the corresponding position in the other sequence, then the molecules are homologous at that position (i.e., as used herein amino acid or nucleic acid "homology" is equivalent to amino acid or nucleic acid "identity"). The same type of comparison can be made between two nucleic acid sequences.

The percent homology between the two sequences is a function of the number of identical positions shared by the sequences (i.e., % homology=numbers of identical positions/total numbers of positions×100). Preferably, the isolated Rfo protein homologs included in the present invention are at least about 50–60%, preferably at least about 60–70%, and more preferably at least about 70–80%, 80–90%, 90–95%, and most preferably at least about 96%, 97%, 98%, 99% or more homologous to an entire amino acid sequence shown in herein. In yet another embodiment, the isolated Rfo protein homologs included in the present invention are at least about 50–60%, preferably at least about 60–70%, and more preferably at least about 70–80%, 80–90%, 90–95%, and most preferably at least about 96%, 97%, 98%, 99% or more homologous to an entire amino acid sequence encoded by a nucleic acid sequence shown herein. In other embodiments, the isolated Rfo protein homologs have homology over at least 15 contiguous amino acid residues, more preferably at least 25 contiguous amino acid residues, and most preferably at least 35 contiguous amino acid residues of the sequences shown herein. In a further preferred embodiment, the Rfo homologs have greater than 90% homology over the PPR motif.

In another preferred embodiment, an isolated Rfo nucleic acid homolog of the invention comprises a nucleotide sequence which is at least about 50–60%, preferably at least about 60–70%, more preferably at least about 70–80%, 80–90%, or 90–95%, and even more preferably at least about 95%, 96%, 97%, 98%, 99% or more homologous to a nucleotide sequence shown herein, or a portion thereof. The preferable length of sequence comparison for nucleic acids is at least 75 nucleotides, more preferably at least 100 nucleotides and most preferably the entire coding region of the nucleic acid.

With regard to the present invention, a determination of the percent homology between two sequences is accomplished using a mathematical algorithm. In a preferred embodiment of the present invention, the percent homology between two sequences is determined using the mathematical algorithm of Karlin and Altschul (1990 Proc. Natl. Acad. Sci. USA 90:5873–5877). Such an algorithm is incorporated into the NBLAST and XBLAST programs of Altschul, et al. (1990 J. Mol. Biol. 215:403–410). Accordingly, the present invention includes a Rfo nucleic acid homolog having at least 50% homology with the nucleotide sequence shown herein as determined using the NBLAST program, score=100, wordlength=12. Additionally, the present invention includes a Rfo amino acid homolog having at least 70% homology with the amino acid sequence shown herein as determined using the XBLAST program, score=50, wordlength=3. When BLAST programs are used to determine percent homology, Gapped BLAST is utilized as described in Altschul et al. (1997 Nucleic Acids Res. 25:3389–3402). When utilizing BLAST and Gapped BLAST programs, the default parameters of the respective programs (e.g., XBLAST and NBLAST) are used.

In another embodiment of the present invention, the percent homology between two sequences is determined using the mathematical algorithm of Smith and Waterman. In yet another embodiment, the percent homology between two sequences is determined using the mathematical algorithm of Myers and Miller (CABIOS 1989). The Myers and Miller algorithm is incorporated into the ALIGN program (version 2.0) that is part of the GCG sequence alignment software package. When utilizing the ALIGN program for comparing amino acid sequences, a PAM120 weight residue table, a gap length penalty of 12 and a gap penalty of 4 is used to obtain Rfo amino acid homologs.

Finally, homology between nucleic acid sequences can be determined using hybridization techniques known to those of skill in the art. Accordingly, an isolated Rfo nucleic acid molecule of the invention comprises a nucleotide sequence which hybridizes, e.g., hybridizes under stringent conditions, to the nucleotide sequence shown herein or a portion thereof. More particularly, an isolated nucleic acid molecule of the invention is at least 15 nucleotides in length and hybridizes under stringent conditions to the nucleic acid molecule comprising a nucleotide sequence of herein. In other embodiments, the nucleic acid is at least 30, 50, 100, 250 or more nucleotides in length. Preferably, an isolated nucleic acid homolog of the invention comprises a nucleotide sequence which hybridizes under highly stringent conditions to the nucleotide sequence shown herein and restores fertility when expressed in a cytoplasmic male-sterile plant.

As used herein with regard to hybridization, the term "stringent conditions" refers to 6× sodium chloride/sodium citrate (SSC) at about 45° C., followed by one or more washes in 0.2 to 0.5×SSC, 0.1 to 0.5% SDS at 50 to 68° C. Additionally, the term "highly stringent conditions" refers to 6×SSC at about 45° C., followed by one or more washes in 0.5×SSC, 0.5% SDS at 68° C. Preferably, an isolated nucleic acid molecule of the invention that hybridizes under stringent or highly stringent conditions to a sequence herein corresponds to a naturally occurring nucleic acid molecule. As used herein, a "naturally occurring" nucleic acid molecule refers to an RNA or DNA molecule having a nucleotide sequence that occurs in nature (e.g., encodes a natural protein). In one embodiment, the nucleic acid encodes a naturally occurring *Raphanus sativum* Rfo protein.

Using the above-described methods, and others known to those of skill in the art, one of ordinary skill in the art can isolate homologs of the Rfo nucleic acids comprising a nucleotide sequence shown in SEQ ID NO:1 and Rfo proteins comprising an amino acid sequence shown in SEQ ID NO:4, SEQ ID NO:5 or SEQ ID NO:6. One subset of these homologs comprises allelic variants. As used herein, the term "allelic variant" refers to a nucleotide sequence containing polymorphisms that lead to changes in the amino acid sequences of a Rfo protein and that exist within a natural population (e.g., a plant species or variety). Such natural allelic variations can typically result in 1–5% variance in a Rfo nucleic acid. Allelic variants can be identified by sequencing the nucleic acid sequence of interest in a number of different radish plants, which can be readily carried out by using hybridization probes to identify the same Rfo genetic locus in those radish plants. Any and all such nucleic acid variations and resulting amino acid polymorphisms or variations in a Rfo protein that are the result of natural allelic variation and that do not alter the functional activity of a Rfo protein, are intended to be within the scope of the invention.

Moreover, nucleic acid molecules encoding Rfo proteins from the same or other species such as Rfo analogs, orthologs and paralogs, are intended to be within the scope of the present invention. As used herein, the term "analogs" refers to two nucleic acids that have the same or similar function, but that have evolved separately in unrelated organisms. As used herein, the term "orthologs" refers to two nucleic acids from different species, but that have evolved from a common ancestral gene by speciation. Normally, orthologs encode proteins having the same or similar functions. As also used herein, the term "paralogs" refers to two nucleic acids that are related by duplication within a genome. Paralogs usually have different functions, but these functions may be related (Tatusov, R. L. et al. 1997 Science 278(5338):631–637).

Analogs, orthologs and paralogs of a naturally occurring Rfo nucleic acids can encode proteins that differ from a naturally occurring Rfo protein by post-translational modifications, by amino acid sequence differences, or by both. Post-translational modifications include in vivo and in vitro chemical derivatization of polypeptides, e.g., acetylation, carboxylation, phosphorylation, or glycosylation, and such modifications may occur during polypeptide synthesis or processing or following treatment with isolated modifying enzymes. In particular, orthologs of the invention will generally exhibit at least 80–85%, more preferably 90%, and most preferably 95%, 96%, 97%, 98% or even 99% identity or homology with all or part of a naturally occurring Rfo amino acid sequence and will exhibit a function similar to a Rfo protein. Preferably, a Rfo ortholog of the present invention restores fertility in a cytoplasmic male-sterile plant. More preferably, a Rfo ortholog restores fertility in a cytoplasmic male-sterile Brassica napus plant.

In addition to naturally occurring variants of a Rfo sequence that may exist in the population, the skilled artisan will further appreciate that changes can be introduced by mutation into a nucleotide sequence shown herein, thereby leading to changes in the amino acid sequence of the encoded Rfo protein, without altering the functional activity of the Rfo protein. For example, nucleotide substitutions leading to amino acid substitutions at "non-essential" amino acid residues can be made in the sequences. A "non-essential" amino acid residue is a residue that can be altered from the wild-type sequence of one of the Rfo proteins without altering the activity of said Rfo protein, whereas an "essential" amino acid residue is required for Rfo protein activity. Other amino acid residues, however, (e.g., those not within the PPR motif described above) may not be essential for activity and thus are likely to be amenable to alteration without altering Rfo activity.

Accordingly, an isolated nucleic acid molecule encoding a Rfo protein homologous to a protein sequence herein can be created by introducing one or more nucleotide substitutions, additions or deletions into a nucleotide sequence such that one or more amino acid substitutions, additions or deletions are introduced into the encoded protein. Mutations can be introduced into one of the sequences by standard techniques, such as site-directed mutagenesis and PCR-mediated mutagenesis. Preferably, conservative amino acid substitutions are made at one or more predicted non-essential amino acid residues. A "conservative amino acid substitution" is one in which the amino acid residue is replaced with an amino acid residue having a similar side chain.

Families of amino acid residues having similar side chains have been defined in the art. These families include amino acids with basic side chains (e.g., lysine, arginine, histidine), acidic side chains (e.g., aspartic acid, glutamic acid), uncharged polar side chains (e.g., glycine, asparagine, glutamine, serine, threonine, tyrosine, cysteine), nonpolar side chains (e.g., alanine, valine, leucine, isoleucine, proline, phenylalanine, methionine, tryptophan), beta-branched side chains (e.g., threonine, valine, isoleucine) and aromatic side chains (e.g., tyrosine, phenylalanine, tryptophan, histidine). Thus, a predicted nonessential amino acid residue in a Rfo is preferably replaced with another amino acid residue from the same side chain family. Alternatively, in another embodiment, mutations can be introduced randomly along all or part of a Rfo coding sequence, such as by saturation mutagenesis, and the resultant mutants can be screened for a Rfo activity described herein to identify mutants that retain Rfo activity. Following mutagenesis of the sequence, the encoded protein can be expressed and the activity of the protein can be determined by analyzing the viable pollen production of a plant expressing the protein as described above. For example, a Rfo mutant that retains activity restores fertility in a male-sterile plant upon its expression in the plant.

Additionally, optimized Rfo nucleic acids can be created. Preferably, an optimized Rfo nucleic acid encodes a Rfo that restores fertility in a cytoplasmic male-sterile plant, and more particularly cytoplasmic male-sterile Brassica napus plant. As used herein, "optimized" refers to a nucleic acid that is genetically engineered to increase its expression in a given plant or animal. To provide plant optimized Rfo nucleic acids, the DNA sequence of the gene can be modified to 1) comprise codons preferred by highly expressed plant genes; 2) comprise an A+T content in nucleotide base composition to that substantially found in plants; 3) form a plant initiation sequence, 4) eliminate sequences that cause destabilization, inappropriate polyadenylation, degradation and termination of RNA, or that form secondary structure hairpins or RNA splice sites. Increased expression of Rfo nucleic acids in plants can be achieved by utilizing the distribution frequency of codon usage in plants in general or a particular plant such as Brassica napus.

As used herein, "frequency of preferred codon usage" refers to the preference exhibited by a specific host cell in usage of nucleotide codons to specify a given amino acid. To determine the frequency of usage of a particular codon in a gene, the number of occurrences of that codon in the gene is divided by the total number of occurrences of all codons specifying the same amino acid in the gene. Similarly, the frequency of preferred codon usage exhibited by a host cell can be calculated by averaging the frequency of preferred codon usage in a large number of genes expressed by the host cell. It is preferable that this analysis be limited to genes that are highly expressed by the host cell. The percent deviation of the frequency of preferred codon usage for a synthetic gene from that employed by a host cell is calculated first by determining the percent deviation of the frequency of usage of a single codon from that of the host cell followed by obtaining the average deviation over all codons. As defined herein, this calculation includes unique codons (i.e., ATG and TGG). In general terms, the overall average deviation of the codon usage of an optimized gene from that of a host cell is calculated using the equation $1A=n=1 \ Z \ X_n-Y_nX_n$ times $100 \ Z$ where $X_n$=frequency of usage for codon n in the host cell; $Y_n$=frequency of usage for codon n in the synthetic gene, n represents an individual codon that specifies an amino acid and the total number of codons is Z. The overall deviation of the frequency of codon usage, A, for all amino acids should preferably be less than about 25%, and more preferably less than about 10%.

Hence, a Rfo nucleic acid can be optimized such that its distribution frequency of codon usage deviates, preferably, no more than 25% from that of highly expressed plant genes and, more preferably, no more than about 10%. In addition, consideration is given to the percentage G+C content of the degenerate third base (monocotyledons appear to favor G+C in this position, whereas dicotyledons do not). It is also recognized that the XCG (where X is A, T, C, or G) nucleotide is the least preferred codon in dicots whereas the XTA codon is avoided in both monocots and dicots. Optimized Rfo nucleic acids of this invention also preferably have CG and TA doublet avoidance indices closely approximating those of the chosen host plant (i.e., *Brassica napus*). More preferably these indices deviate from that of the host by no more than about 10–15%.

In addition to the nucleic acid molecules encoding the Rfo's described above, another aspect of the invention pertains to isolated nucleic acid molecules that are antisense thereto. An "antisense" nucleic acid comprises a nucleotide sequence that is complementary to a "sense" nucleic acid encoding a protein, e.g., complementary to the coding strand of a double-stranded cDNA molecule or complementary to an mRNA sequence. Accordingly, an antisense nucleic acid can hydrogen bond to a sense nucleic acid. The antisense nucleic acid can be complementary to an entire Rfo coding strand, or to only a portion thereof. In one embodiment, an antisense nucleic acid molecule is antisense to a "coding region" of the coding strand of a nucleotide sequence encoding a Rfo. The term "coding region" refers to the region of the nucleotide sequence comprising codons that are translated into amino acid residues. In another embodiment, the antisense nucleic acid molecule is antisense to a "noncoding region" of the coding strand of a nucleotide sequence encoding a Rfo. The term "noncoding region" refers to 5' and 3' sequences that flank the coding region that are not translated into amino acids (i.e., also referred to as 5' and 3' untranslated regions).

In a preferred embodiment, an isolated nucleic acid molecule of the invention comprises a nucleic acid molecule which is a complement of the nucleotide sequence shown herein, or a portion thereof. A nucleic acid molecule that is complementary to the nucleotide sequence shown herein is one which is sufficiently complementary to the nucleotide sequence shown such that it can hybridize to the nucleotide sequence shown, thereby forming a stable duplex.

Given the coding strand sequences encoding the Rfo's disclosed herein, antisense nucleic acids of the invention can be designed according to the rules of Watson and Crick base pairing. The antisense nucleic acid molecule can be complementary to the entire coding region of Rfo mRNA, but more preferably is an oligonucleotide which is antisense to only a portion of the coding or noncoding region of Rfo mRNA. For example, the antisense oligonucleotide can be complementary to the region surrounding the translation start site of Rfo mRNA. An antisense oligonucleotide can be, for example, about 5, 10, 15, 20, 25, 30, 35, 40, 45 or 50 or more nucleotides in length.

An antisense nucleic acid of the invention can be constructed using chemical synthesis and enzymatic ligation reactions using procedures known in the art. For example, an antisense nucleic acid (e.g., an antisense oligonucleotide) can be chemically synthesized using naturally occurring nucleotides or variously modified nucleotides designed to increase the biological stability of the molecules or to increase the physical stability of the duplex formed between the antisense and sense nucleic acids, e.g., phosphorothioate derivatives and acridine substituted nucleotides can be used. Examples of modified nucleotides which can be used to generate the antisense nucleic acid include 5-fluorouracil, 5-bromouracil, 5-chlorouracil, 5-iodouracil, hypoxanthine, xanthine, 4-acetylcytosine, 5-(carboxyhydroxylmethyl) uracil, 5-carboxymethylaminomethyl-2-thiouridine, 5-carboxymethylaminomethyluracil, dihydrouracil, beta-D-galactosylqueosine, inosine, N6-isopentenyladenine, 1-methylguanine, 1-methylinosine, 2,2-dimethylguanine, 2-methyladenine, 2-methylguanine, 3-methylcytosine, 5-methylcytosine, N6-adenine, 7-methylguanine, 5-methylaminomethyluracil, 5-methoxyaminomethyl-2-thiouracil, beta-D-mannosylqueosine, 5'-methoxycarboxymethyluracil, 5-methoxyuracil, 2-methylthio-N6-isopentenyladenine, uracil-5-oxyacetic acid (v), wybutoxosine, pseudouracil, queosine, 2-thiocytosine, 5-methyl-2-thiouracil, 2-thiouracil, 4-thiouracil, 5-methyluracil, uracil-5-oxyacetic acid methylester, uracil-5-oxyacetic acid (v), 5-methyl-2-thiouracil, 3-(3-amino-3-N-2-carboxypropyl) uracil, (acp3)w, and 2,6-diaminopurine. Alternatively, the antisense nucleic acid can be produced biologically using an expression vector into which a nucleic acid has been subcloned in an antisense orientation (i.e., RNA transcribed from the inserted nucleic acid will be of an antisense orientation to a target nucleic acid of interest, described further in the following subsection).

The antisense nucleic acid molecules of the invention are typically administered to a cell or generated in situ such that they hybridize with or bind to cellular mRNA and/or genomic DNA encoding a Rfo to thereby inhibit expression of the protein, e.g., by inhibiting transcription and/or translation. The hybridization can be by conventional nucleotide complementarity to form a stable duplex, or, for example, in the case of an antisense nucleic acid molecule which binds to DNA duplexes, through specific interactions in the major groove of the double helix. The antisense molecule can be modified such that it specifically binds to a receptor or an antigen expressed on a selected cell surface, e.g., by linking the antisense nucleic acid molecule to a peptide or an antibody which binds to a cell surface receptor or antigen. The antisense nucleic acid molecule can also be delivered to cells using the vectors described herein. To achieve sufficient intracellular concentrations of the antisense molecules, vector constructs in which the antisense nucleic acid molecule is placed under the control of a strong prokaryotic, viral, or eukaryotic (including plant) promoter are preferred.

In yet another embodiment, the antisense nucleic acid molecule of the invention is an α-anomeric nucleic acid molecule. An α-anomeric nucleic acid molecule forms specific double-stranded hybrids with complementary RNA in which, contrary to the usual β-units, the strands run parallel to each other (Gaultier et al., 1987 Nucleic Acids. Res. 15:6625–6641). The antisense nucleic acid molecule can also comprise a 2'-o-methylribonucleotide (Inoue et al., 1987 Nucleic Acids Res. 15:6131–6148) or a chimeric RNA-DNA analogue (Inoue et al., 1987 FEBS Lett. 215: 327–330).

In still another embodiment, an antisense nucleic acid of the invention is a ribozyme. Ribozymes are catalytic RNA molecules with ribonuclease activity that are capable of cleaving a single-stranded nucleic acid, such as an mRNA, to which they have a complementary region. Thus, ribozymes (e.g., hammerhead ribozymes described in Haselhoff and Gerlach, 1988 Nature 334:585–591) can be used to catalytically cleave Rfo mRNA transcripts to thereby inhibit translation of Rfo mRNA. A ribozyme having specificity for a Rfo-encoding nucleic acid can be designed based upon the nucleotide sequence of a Rfo cDNA, corresponding to an ORF of a Rfo nucleic acid provided herein or on the basis of a heterologous sequence to be isolated according to methods taught in this invention. For example, a derivative of a Tetrahymena L-19 IVS RNA can be constructed in which the nucleotide sequence of the active site is complementary to the nucleotide sequence to be cleaved in a Rfo-encoding mRNA. See, e.g., Cech et al. U.S. Pat. No. 4,987,071 and Cech et al. U.S. Pat. No. 5,116,742. Alternatively, Rfo mRNA can be used to select a catalytic RNA having a specific ribonuclease activity from a pool of RNA molecules. See, e.g., Bartel, D. and Szostak, J. W., 1993 Science 261:1411–1418.

Alternatively, Rfo gene expression can be inhibited by targeting nucleotide sequences complementary to the regulatory region of a Rfo nucleotide sequence (e.g., a Rfo promoter and/or enhancer) to form triple helical structures that prevent transcription of a Rfo gene in target cells. See generally, Helene, C., 1991 Anticancer Drug Des. 6(6): 569–84; Helene, C. et al., 1992 Ann. N.Y. Acad. Sci. 660:27–36; and Maher, L. J., 1992 Bioassays 14(12):807–15.

In addition to the Rfo nucleic acids and proteins described above, the present invention encompasses these nucleic acids and proteins attached to a moiety. These moieties include, but are not limited to, detection moieties, hybridization moieties, purification moieties, delivery moieties, reaction moieties, binding moieties, and the like. A typical group of nucleic acids having moieties attached includes probes and primers. Probes and primers typically comprise a substantially isolated oligonucleotide. The oligonucleotide typically comprises a region of nucleotide sequence that hybridizes under stringent conditions to at least about 12, preferably about 25, more preferably about 40, 50 or 75 consecutive nucleotides of a sense strand of the sequence set forth in the sequences, an anti-sense sequence of the sequence set forth in the sequences, or naturally occurring mutants thereof. Primers based on a nucleotide sequences herein can be used in PCR reactions to clone Rfo homologs. Probes based on the Rfo nucleotide sequences can be used to detect transcripts or genomic sequences encoding the same or homologous proteins. In preferred embodiments, the probe further comprises a label group such as a radio-isotope, a fluorescent compound, an enzyme or an enzyme co-factor. Such probes can be used as a part of a genomic marker test kit for identifying cells which express a Rfo nucleic acid, such as by measuring a level of a Rfo-encoding nucleic acid, in a sample of cells, e.g., detecting Rfo mRNA levels or determining whether a genomic Rfo gene has been mutated or deleted.

The invention further provides an isolated recombinant expression vector comprising a Rfo nucleic acid as described above, wherein expression of the vector in a host plant results in increased produced of viable pollen. As used herein, the term "vector" refers to a nucleic acid molecule capable of transporting another nucleic acid to which it has been linked. One type of vector is a "plasmid" which refers to a circular double stranded DNA loop into which additional DNA segments can be ligated. Another type of vector is a viral vector, wherein additional DNA segments can be ligated into the viral genome. Certain vectors are capable of autonomous replication in a host cell into which they are introduced (e.g., bacterial vectors having a bacterial origin of replication and episomal mammalian vectors). Other vectors (e.g., non-episomal mammalian vectors) are integrated into the genome of a host cell upon introduction into the host cell, and thereby are replicated along with the host genome. Moreover, certain vectors are capable of directing the expression of genes to which they are operatively linked. Such vectors are referred to herein as "expression vectors". In general, expression vectors of utility in recombinant DNA techniques are often in the form of plasmids. In the present specification, "plasmid" and "vector" can be used interchangeably as the plasmid is the most commonly used form of vector. However, the invention is intended to include such other forms of expression vectors, such as viral vectors (e.g., replication defective retroviruses, adenoviruses and adeno-associated viruses), which serve equivalent functions.

The recombinant expression vectors of the invention comprise a nucleic acid of the invention in a form suitable for expression of the nucleic acid in a host cell, which means that the recombinant expression vectors include one or more regulatory sequences, selected on the basis of the host cells to be used for expression, which is operatively linked to the nucleic acid sequence to be expressed. Within a recombinant expression vector, "operably linked" is intended to mean that the nucleotide sequence of interest is linked to the regulatory sequence(s) in a manner which allows for expression of the nucleotide sequence (e.g., in an in vitro transcription/translation system or in a host cell when the vector is introduced into the host cell). The term "regulatory sequence" is intended to include promoters, enhancers and other expression control elements (e.g., polyadenylation signals). Such regulatory sequences are described, for example, in Goeddel, Gene Expression Technology: Methods in Enzymology 185, Academic Press, San Diego, Calif. (1990) or see: Gruber and Crosby, in: Methods in Plant Molecular Biology and Biotechnology, eds. Glick and Thompson, Chapter 7, 89–108, CRC Press: Boca Raton, Fla., including the references therein. Regulatory sequences include those that direct constitutive expression of a nucleotide sequence in many types of host cells and those that direct expression of the nucleotide sequence only in certain host cells or under certain conditions. It will be appreciated by those skilled in the art that the design of the expression vector can depend on such factors as the choice of the host cell to be transformed, the level of expression of protein desired, etc. The expression vectors of the invention can be introduced into host cells to thereby produce proteins or peptides, including fusion proteins or peptides, encoded by nucleic acids as described herein (e.g., Rfo proteins, mutant forms of Rfo proteins, fusion proteins, etc.).

The recombinant expression vectors of the invention can be designed for expression of Rfo's in prokaryotic or eukaryotic cells. For example, Rfo genes can be expressed in multicellular plant cells (see Schmidt, R. and Willmitzer, L., 1988 High efficiency *Agrobacterium tumefaciens*-mediated transformation of *Arabidopsis thaliana* leaf and cotyledon explants, Plant Cell Rep. 583–586); Plant Molecular Biology and Biotechnology, C Press, Boca Raton, Fla., chapter 6/7, S.71–119 (1993); F. F. White, B. Jenes et al., Techniques for Gene Transfer, in: Transgenic Plants, Vol. 1, Engineering and Utilization, eds. Kung und R. Wu, 128–43, Academic Press: 1993; Potrykus, 1991 Annu. Rev. Plant Physiol. Plant Molec. Biol. 42:205–225 and references cited therein); *C. glutamicum,* insect cells (using baculovirus expression vectors), yeast and other fungal cells (see Romanos, M. A. et al., 1992 Foreign gene expression in yeast: a review, Yeast 8:423–488; van den Hondel, C. A. M. J. J. et al., 1991 Heterologous gene expression in filamentous fungi, in: More Gene Manipulations in Fungi, J. W. Bennet & L. L. Lasure, eds., p. 396–428: Academic Press: San Diego; and van den Hondel, C. A. M. J. J. & Punt, P. J., 1991 Gene transfer systems and vector development for filamentous fungi, in: Applied Molecular Genetics of Fungi, Peberdy, J. F. et al., eds., p. 1–28, Cambridge University Press: Cambridge), algae (Falciatore et al., 1999 Marine Biotechnology 1(3):239–251) or mammalian cells. Suitable host cells are discussed further in Goeddel, *Gene Expression Technology: Methods in Enzymology* 185, Academic Press: San Diego, Calif. (1990). Alternatively, the recombinant expression vector can be transcribed and translated in vitro, for example using T7 promoter regulatory sequences and T7 polymerase.

Expression of proteins in prokaryotes is most often carried out with vectors containing constitutive or inducible promoters directing the expression of either fusion or non-fusion proteins. Fusion vectors add a number of amino acids to a protein encoded therein, usually to the amino terminus of the recombinant protein but also to the C-terminus or fused within suitable regions in the proteins. Such fusion vectors typically serve three purposes: 1) to increase expression of a recombinant protein; 2) to increase the solubility of a recombinant protein; and 3) to aid in the purification of a recombinant protein by acting as a ligand in affinity purification. Often, in fusion expression vectors, a proteolytic cleavage site is introduced at the junction of the fusion moiety and the recombinant protein to enable separation of the recombinant protein from the fusion moiety subsequent to purification of the fusion protein. Such enzymes, and their cognate recognition sequences, include Factor Xa, thrombin and enterokinase.

Typical fusion expression vectors include pGEX (Pharmacia Biotech Inc; Smith, D. B. and Johnson, K. S., 1988 Gene 67:31–40), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. In one embodiment, the coding sequence of the Rfo is cloned into a pGEX expression vector to create a vector encoding a fusion protein comprising, from the N-terminus to the C-terminus, GST-thrombin cleavage site-X protein. The fusion protein can be purified by affinity chromatography using glutathione-agarose resin. Recombinant Rfo unfused to GST can be recovered by cleavage of the fusion protein with thrombin.

Examples of suitable inducible non-fusion *E. coli* expression vectors include pTrc (Amann et al., 1988 Gene 69:301–315) and pET 11d (Studier et al., *Gene Expression Technology: Methods in Enzymology* 185, Academic Press, San Diego, Calif. (1990) 60–89). Target gene expression from the pTrc vector relies on host RNA polymerase transcription from a hybrid trp-lac fusion promoter. Target gene expression from the pET 11d vector relies on transcription from a T7 gn10-lac fusion promoter mediated by a co-expressed viral RNA polymerase (T7 gn1). This viral polymerase is supplied by host strains BL21(DE3) or HMS174 (DE3) from a resident λ prophage harboring a T7 gn1 gene under the transcriptional control of the lacUV 5 promoter.

In another embodiment, the Rfo expression vector is a yeast expression vector. Examples of vectors for expression in yeast *S. cerevisiae* include pYepSec1 (Baldari, et al., 1987 EMBO J. 6:229–234), pMFa (Kurjan and Herskowitz, 1982 Cell 30:933–943), pJRY88 (Schultz et al., 1987 Gene 54:113–123), and pYES2 (invitrogen Corporation, San Diego, Calif.). Vectors and methods for the construction of vectors appropriate for use in other fungi, such as the filamentous fungi, include those detailed in: van den Hondel, C. A. M. J. J. & Punt, P. J. (1991) "Gene transfer systems and vector development for filamentous fungi", in: Applied Molecular Genetics of Fungi, J. F. Peberdy, et al., eds., p. 1–28, Cambridge University Press: Cambridge.

Alternatively, the Rfo of the invention can be expressed in insect cells using baculovirus expression vectors. Baculovirus vectors available for expression of proteins in cultured insect cells (e.g., Sf 9 cells) include the pAc series (Smith et al., 1983 Mol. Cell Biol. 3:2156–2165) and the pVL series (Lucklow and Summers, 1989 Virology 170:31–39).

In another embodiment, the Rfo of the invention may be expressed in unicellular plant cells (such as algae) (see Falciatore et al., 1999 Marine Biotechnology 1(3):239–251 and references therein), and more preferably, plant cells from higher plants (e.g., the spermatophytes, such as crop plants). Examples of plant expression vectors include those detailed in: Becker, D., Kemper, E., Schell, J. and Masterson, R., 1992 New plant binary vectors with selectable markers located proximal to the left border, Plant Mol. Biol. 20: 1195–1197; and Bevan, M. W., 1984 Binary *Agrobacterium* vectors for plant transformation, Nucl. Acid. Res. 12:8711–8721; Vectors for Gene Transfer in Higher Plants; in: Transgenic Plants, Vol. 1, Engineering and Utilization, eds.: Kung and R. Wu, Academic Press, 1993, S. 15–38.

A plant expression cassette preferably contains regulatory sequences capable of driving gene expression in plant cells and operably linked so that each sequence can fulfill its function, for example, termination of transcription by polyadenylation signals. Preferred polyadenylation signals are those originating from *Agrobacterium tumefaciens* t-DNA such as the gene 3 known as octopine synthase of the Ti-plasmid pTiACH5 (Gielen et al., 1984 EMBO J. 3:835) or functional equivalents thereof but also all other terminators functionally active in plants are suitable. As plant gene expression is very often not limited on transcriptional levels, a plant expression cassette preferably contains other operably linked sequences like translational enhancers such as the overdrive-sequence containing the 5'-untranslated leader sequence from tobacco mosaic virus enhancing the protein per RNA ratio (Gallie et al., 1987 Nucl. Acids Research 15:8693–8711).

Plant gene expression must be operably linked to an appropriate promoter in order to confer gene expression in a timely, cell or tissue specific manner. Preferred are promoters driving constitutive expression (Benfey et al., 1989 EMBO J. 8:2195–2202) like those derived from plant viruses like the 35S CAMV (Franck et al., 1980 Cell 21:285–294), the 19S CaMV (see also U.S. Pat. No. 5,352, 605 and PCT Application No. WO 8402913) or plant promoters like those from Rubisco small subunit described in U.S. Pat. No. 4,962,028.

Especially preferred are those promoters that confer gene expression in specific plant tissues and organs, such as stamens and anthers. In this regard, a promoter which expresses during stamen development would be preferred as such a promoter is particularly appropriate to drive Rfo expression resulting in altered pollen production as desired. Examples of such promoters include the AP3 promoter, the Lat52 promoter (Twell, D. et al. (1989). Mol. Gen. Genet. 217, 240–248; Twell, D. et al. (1990). Development 109, 705–715.), the A9 promoter (Paul, W. et al., (1992). Plant Mol. Biol. 19, 611–622.), the fbp1 promoter (Angenent, G. C. (1993). Plant J. 4, 101–112), the EPF2-5 promoter (Takatsuji, H. et al. (1994). Plant Cell 6, 947–958), and the pfn4 promoter (Christensen, H. E. et al. (1996). Plant J. 10, 269–279). However, the utility of the present methods are not restricted with respect to the promoter. As will be appreciated by one of skill in the art, constitutive promoters and promoters which express during other stages of plant development, for example prior to stamen development, may also be useful in the present methods.

Plant gene expression can also be facilitated via an inducible promoter (for review, see Gatz, 1997 Annu. Rev. Plant Physiol. Plant Mol. Biol. 48:89–108). Chemically inducible promoters are especially suitable if gene expression is wanted to occur in a time specific manner. Examples of such promoters are a salicylic acid inducible promoter (PCT Application No. WO 95/19443), a tetracycline inducible promoter (Gatz et al., 1992 Plant J. 2:397–404) and an ethanol inducible promoter (PCT Application No. WO 93/21334).

Other preferred sequences for use in plant gene expression cassettes are targeting-sequences necessary to direct the gene product in its appropriate cell compartment (for review see Kermode, 1996 Crit. Rev. Plant Sci. 15(4):285–423 and references cited therein) such as the vacuole, the nucleus, all types of plastids like amyloplasts, chloroplasts, chromoplasts, the extracellular space, mitochondria, the endoplasmic reticulum, oil bodies, peroxisomes and other compartments of plant cells.

In addition to providing a recombinant expression vector comprising a Rfo DNA molecule of the invention cloned into the expression vector in a sense orientation, the present invention provides such a vector wherein the Rfo DNA molecule is cloned into the vector in the antisense orientation. That is, the DNA molecule is operatively linked to a regulatory sequence in a manner that allows for expression (by transcription of the DNA molecule) of an RNA molecule that is antisense to a Rfo mRNA. Regulatory sequences operatively linked to a nucleic acid molecule cloned in the antisense orientation can be chosen which direct the continuous expression of the antisense RNA molecule in a variety of cell types. For instance, viral promoters and/or enhancers, or regulatory sequences can be chosen which direct constitutive, tissue specific or cell type specific expression of antisense RNA. The antisense expression vector can be in the form of a recombinant plasmid, phagemid or attenuated virus wherein antisense nucleic acids are produced under the control of a high efficiency regulatory region. The activity of the regulatory region can be determined by the cell type into which the vector is introduced. For a discussion of the regulation of gene expression using antisense genes see Weintraub, H. et al., Antisense RNA as a molecular tool for genetic analysis, Reviews—Trends in Genetics, Vol. 1(1) 1986 and Mol et al., 1990 FEBS Letters 268:427–430. The term antisense RNA is intended to also cover double stranded interfering RNAs (RNAi), which induce selective degradation of the RNAs complementary to one of the two dsRNA strands.

Another aspect of the invention pertains to host cells into which a recombinant expression vector of the invention has been introduced. The terms "host cell" and "recombinant host cell" are used interchangeably herein. It is understood that such terms refer not only to the particular subject cell but they also apply to the progeny or potential progeny of such a cell. Because certain modifications may occur in succeeding generations due to either mutation or environmental influences, such progeny may not, in fact, be identical to the parent cell, but are still included within the scope of the term as used herein. A host cell can be any prokaryotic or eukaryotic cell. For example, a Rfo can be expressed in bacterial cells such as *C. glutamicum,* insect cells, fungal cells or mammalian cells (such as Chinese hamster ovary cells (CHO) or COS cells), algae, ciliates, plant cells, fungi or other microorganisms like *C. glutamicum.* In a preferred embodiment, the host cell is a plant cell, more preferably, a *Brassica napus* plant cell, and most preferably, a stamen or anther cell.

Vector DNA can be introduced into prokaryotic or eukaryotic cells via conventional transformation or transfection techniques. As used herein, the terms "transformation", "transfection", "conjugation" and "transduction" are intended to refer to a variety of art-recognized techniques for introducing foreign nucleic acid (e.g., DNA) into a host cell, including calcium phosphate or calcium chloride co-precipitation, DEAE-dextran-mediated transfection, lipofection, natural competence, chemical-mediated transfer and electroporation. Suitable methods for transforming or transfecting host cells including plant cells can be found in Sambrook, et al. (Molecular Cloning: A Laboratory Manual. $2^{nd}$, ed., Cold Spring Harbor Laboratory, Cold Spring Harbor Laboratory Press, Cold Spring Harbor, N.Y., 1989) and other laboratory manuals such as Methods in Molecular Biology, 1995, Vol. 44, *Agrobacterium* protocols, ed: Gartland and Davey, Humana Press, Totowa, N.J.

In particular, the invention provides a method of producing a transgenic plant with a Rfo coding nucleic acid, wherein the plant is a cytoplasmic male-sterile plant and wherein expression of the nucleic acid in the plant results in restoration of fertility of the plant comprising: (a) transforming a plant cell with an expression vector comprising a Rfo nucleic acid, and (b) generating from the plant cell a transgenic plant. The plant cell includes, but is not limited to, a gamete producing cell, a protoplast and any other cell that regenerates into a whole plant.

For such plant transformation, binary vectors such as pBinAR can be used (Höfgen and Willmitzer, 1990 Plant Science 66:221–230). Construction of the binary vectors can be performed by ligation of the cDNA in sense or antisense orientation into the T-DNA. 5-prime to the cDNA a plant promoter activates transcription of the cDNA. A polyadenylation sequence is located 3-prime to the cDNA. Tissue-specific expression can be achieved by using a tissue specific promoter. For constitutive expression within the whole plant, the CaMV 35S promoter can be used. The expressed protein can be targeted to a cellular compartment using a signal peptide, for example for plastids, mitochondria or endoplasmic reticulum (Kermode, 1996 Crit. Rev. Plant Sci. 4 (15):285–423). The signal peptide is cloned 5-prime in frame to the cDNA to archive subcellular localization of the fusion protein. One skilled in the art will recognize that the promoter used should be operatively linked to the nucleic acid such that the promoter causes transcription of the nucleic acid and results in the synthesis of a mRNA which encodes a polypeptide. Alternatively, the RNA can be an antisense RNA for use in affecting subsequent expression of the same or another gene or genes.

Alternate methods of transfection include the direct transfer of DNA into developing flowers via electroporation or *Agrobacterium* mediated gene transfer. *Agrobacterium* mediated plant transformation can be performed using for example the GV3101(pMP90) (Koncz and Schell, 1986 Mol. Gen. Genet. 204:383–396) or LBA4404 (Clontech) *Agrobacterium tumefaciens* strain. Transformation can be performed by standard transformation and regeneration techniques (Deblaere et al., 1994 Nucl. Acids. Res. 13:4777–4788; Gelvin, Stanton B. and Schilperoort, Robert A, Plant Molecular Biology Manual, $2^{nd}$ Ed.—Dordrecht: Kluwer Academic Publ., 1995.—in Sect., Ringbuc Zentrale Signatur: BT11-P ISBN 0-7923-2731-4; Glick, Bernard R.; Thompson, John E., Methods in Plant Molecular Biology and Biotechnology, Boca Raton: CRC Press, 1993 360 S., ISBN 0-8493-5164-2).

A host cell of the invention, such as a prokaryotic or eukaryotic host cell in culture, can be used to produce (i.e., express) a Rfo. Accordingly, the invention further provides methods for producing Rfo proteins using the host cells of the invention. In one embodiment, the method comprises culturing the host cell of invention (into which a recombinant expression vector encoding a Rfo protein has been introduced, or into which genome has been introduced a gene encoding a wild-type or altered Rfo protein) in a suitable medium until Rfo protein is produced. In another embodiment, the method further comprises isolating Rfo proteins from the medium or the host cell.

Another aspect of the invention pertains to isolated Rfo proteins, and biologically active portions thereof. An "isolated" or "purified" protein or biologically active portion thereof is free of some of the cellular material when produced by recombinant DNA techniques, or chemical precursors or other chemicals when chemically synthesized. The language "substantially free of cellular material" includes preparations of Rfo protein in which the protein is separated from some of the cellular components of the cells in which it is naturally or recombinantly produced. In one embodiment, the language "substantially free of cellular material" includes preparations of a Rfo protein having less than about 30% (by dry weight) of non-Rfo protein material (also referred to herein as a "contaminating protein"), more preferably less than about 20% of non-Rfo protein material, still more preferably less than about 10% of non-Rfo protein material, and most preferably less than about 5% non-Rfo protein material.

When the Rfo protein or biologically active portion thereof is recombinantly produced, it is also preferably substantially free of culture medium, i.e., culture medium represents less than about 20%, more preferably less than about 10%, and most preferably less than about 5% of the volume of the protein preparation. The language "substantially free of chemical precursors or other chemicals" includes preparations of Rfo protein in which the protein is separated from chemical precursors or other chemicals that are involved in the synthesis of the protein. In one embodiment, the language "substantially free of chemical precursors or other chemicals" includes preparations of a Rfo protein having less than about 30% (by dry weight) of chemical precursors or non-Rfo protein chemicals, more preferably less than about 20% chemical precursors or non-Rfo protein chemicals, still more preferably less than about 10% chemical precursors or non-Rfo protein chemicals, and most preferably less than about 5% chemical precursors or non-Rfo protein chemicals. In preferred embodiments, isolated proteins, or biologically active portions thereof, lack contaminating proteins from the same organism from which the Rfo protein is derived.

The present invention also provides antibodies that specifically bind to a Rfo protein, or a portion thereof, as encoded by a nucleic acid described herein. Antibodies can be made by many well-known methods (See, e.g. Harlow and Lane, "Antibodies; A Laboratory Manual" Cold Spring Harbor Laboratory, Cold Spring Harbor, N.Y., (1988)). Briefly, purified antigen can be injected into an animal in an amount and in intervals sufficient to elicit an immune response. Antibodies can either be purified directly, or spleen cells can be obtained from the animal. The cells can then fused with an immortal cell line and screened for antibody secretion. The antibodies can be used to screen nucleic acid clone libraries for cells secreting the antigen. Those positive clones can then be sequenced. (See, for example, Kelly et al., 1992 Bio/Technology 10:163–167; Bebbington et al., 1992 Bio/Technology 10:169–175).

The phrases "selectively binds" and "specifically binds" when referring to binding to a polypeptide refer to a binding reaction that is determinative of the presence of the protein in a heterogeneous population of proteins and other biologics. Thus, under designated immunoassay conditions, the specified antibodies bound to a particular protein do not bind in a significant amount to other proteins present in the sample. Selective binding of an antibody under such conditions may require an antibody that is selected for its specificity for a particular protein. A variety of immunoassay formats may be used to select antibodies that selectively bind with a particular protein. For example, solid-phase ELISA immunoassays are routinely used to select antibodies selectively immunoreactive with a protein. See Harlow and Lane "Antibodies, A Laboratory Manual" Cold Spring Harbor Publications, N.Y., (1988), for a description of immunoassay formats and conditions that could be used to determine selective binding.

In some instances, it is desirable to prepare monoclonal antibodies from various hosts. A description of techniques for preparing such monoclonal antibodies may be found in Stites et al., editors, "Basic and Clinical Immunology," (Lange Medical Publications, Los Altos, Calif., Fourth Edition) and references cited therein, and in Harlow and Lane ("Antibodies, A Laboratory Manual" Cold Spring Harbor Publications, N.Y., 1988).

The nucleic acid molecules, proteins, protein homologs, fusion proteins, primers, vectors, and host cells described herein can be used in one or more of the following methods: producing a hybrid plant that contains the nucleic acid molecules of the present invention, modulating fertility in a plant, increasing production of viable pollen in a cytoplasmic male-sterile plant, restoring fertility in a cytoplasmic male-sterile plant, identifying *Raphanus sativum* and related organisms, mapping of genomes of organisms related to *Raphanus sativum*, identifying and localizing *Raphanus sativum* sequences of interest and performing evolutionary studies.

Accordingly, the present invention provides a method of producing a hybrid plant, comprising crossing a male-fertile plant containing the Rfo nucleic acids of the present invention with a male-sterile plant, collecting hybrid seed from the male-sterile plant and regenerating the hybrid plant from the seed. In a preferred embodiment, the male-sterile plant contains an ogu cytoplasmic male sterility determinant. The present invention also provides a method of modulating the fertility of a transgenic plant that includes expressing a Rfo nucleic acid in the plant. Preferably, the plant comprises a male-sterility determinant and expression of the nucleic acid sequence in the plant results in increased production of viable pollen by the plant. In a preferred embodiment, expression of the nucleic acid sequence in the plant results in restoration of fertility of the plant. In a more preferred embodiment, the plant contains an ogu cytoplasmic male sterility determinant. The present invention describes using the expression of Rfo of *Raphanus sativum* to restore fertility in male-sterile plants. The invention also provides a transgenic plant containing a Rfo nucleic acid or a fragment thereof, wherein the plant has increased fertility or viable pollen production as compared to a cytoplasmic male-sterile plant of the same variety. The transgenic plant can be a monocot or a dicot. The invention further provides that the transgenic plant can be selected from maize, wheat, rye, oat, triticale, rice, barley, soybean, peanut, rapeseed, canola, pepper, sunflower, Vicia species, pea, alfalfa, bushy plants (coffee, cacao, tea), Salix species, radish, sorghum, pearl millet, cotton, and tobacco. In a preferred embodiment, the transgenic plant is a canola plant selected from the group consisting of *Brassica napus, Brassica rapa* (or *campestris*), *Brassica oleracea, Brassica nigra, Brassica juncea, Sinapis alba,* and *Brassica carinata.* In a more preferred embodiment, the male-sterile plant is *Brassica napus.*

The present invention also allows for the production of a true breeding variety of plants that are capable of restoring male fertility in a F1 hybrid descendant of a plant of the present invention and a male-sterile plant. This type of true breeding variety of a fertility restorer plant is also termed a "restorer line". The terms "variety" and "line" refer to a group of plants within a species that share constant characteristics that separate them from the typical form and from other possible varieties within that species. While possessing at least one distinctive trait, a variety or line is also characterized by some variation between individuals within the variety or line, based primarily on the Mendelian segregation of traits among the progeny of succeeding generations. A variety or line is considered "true breeding" for a particular trait if it is genetically homozygous for that trait to the extent that, when the true-breeding variety or line is self-pollinated, a significant amount of independent segregation of the trait among the progeny is not observed. In the present invention, the trait arises from the transgenic expression of a single DNA sequence introduced into a plant variety or plant line.

In addition to introducing the Rfo nucleic acids into transgenic plants, these sequences can also be used to identify a plant as being *Raphanus sativum* or a close relative thereof. Also, they may be used to identify the presence of *Raphanus sativum* or a relative thereof in a mixed population of plants. The invention provides the nucleic acid sequences of a number of *Raphanus sativum* genes; by probing the extracted genomic DNA of a culture of a unique or mixed population of plants under stringent conditions with a probe spanning a region of a *Raphanus sativum* gene which is unique to this plant, one can ascertain whether this plant or the genus is present.

More importantly, the Rfo nucleic acids can be used to isolate Rfo homologs in other species. The nucleotide sequences determined from the cloning of the Rfo genes from *Raphanus sativum* allow for the generation of probes and primers designed for use in identifying and/or cloning Rfo homologs in other cell types and plants such as *Brassica napus*, as well as Rfo homologs from other radishes and related species.

Further, the nucleic acid and protein molecules of the invention may serve as markers for specific regions of the genome. This has utility not only in the mapping of the genome, but also in functional studies of *Raphanus sativum* proteins. For example, to identify the region of the genome to which a particular *Raphanus sativum* DNA-binding protein binds, the *Raphanus sativum* genome could be digested, and the fragments incubated with the DNA-binding protein. Those fragments that bind the protein may be additionally probed with the nucleic acid molecules of the invention, preferably with readily detectable labels. Binding of such a nucleic acid molecule to the genome fragment enables the localization of the fragment to the genome map of *Raphanus sativum*, and, when performed multiple times with different enzymes, facilitates a rapid determination of the nucleic acid sequence to which the protein binds. Further, the nucleic acid molecules of the invention may be sufficiently homologous to the sequences of related species such that these nucleic acid molecules may serve as markers for the construction of a genomic map in related radishes.

The nucleic acid and protein molecules of the invention may also be used as markers to identify regions of the Rfo-radish genome as being tightly genetically-linked to the Rfo gene. For example, DNA sequences given in SEQ ID NO:87 could be used as probes to identify restriction fragment length polymorphisms (Tanksley et al. (1987) In: Chromosome structure and function. Plenum Press N.Y. pp157–173) that are tightly genetically linked to the Rfo gene. These DNA markers could then be used to identify individuals in plant breeding programs that might have a minimal amount of radish DNA in the region flanking Rfo and which therefore would be highly useful for the development of effective, low glucosinolate *B. napus* restorer lines. Similarly, these sequences could be used to design PCR based DNA markers, such as SNPs (The International SNP Map Working Group (2001) Nature 409: 928–933) and SSRs (Tautz D (1989) Nucl Acids Res 17: 6463–6471) that could be used in similar fashion.

The nucleic acid molecules given in SEQ ID NO:87 that function as restorer genes could also be used as selection markers to identify transformed plant cells. For example, a sequence that functions as a restorer gene could be combined with another gene of interest in a transformation vector. The vector could then be introduced into plant cells by any of a number of methods such as *Agrobacterium*-mediated transformation. If the plant cells into which the DNA is introduced are cytoplasmically male sterile, the anthers that form on the regenerated plants will normally not produce any pollen and no seed will form from these flowers by self-pollination. If, however, the anthers form from cells that have acquired a restorer gene and the associated gene of interest, the anthers will produce pollen and these flowers will form seeds. This provides a powerful selection system for the identification of transformed plants or parts of plants. The use of restorer genes, which are purely normal plant genes, as selection markers may have some advantages over other currently used selection markers with respect to regulatory issues. The use of restorer genes as selection markers is not intended to be limited to the ogu CMS system and Rfo, but rather could apply to any restorer gene for any CMS system in any plant species.

The Rfo nucleic acid molecules of the invention are also useful for evolutionary and protein structural studies. By comparing the sequences of the nucleic acid molecules of the present invention to those encoding similar proteins from other organisms, the evolutionary relatedness of the organisms can be assessed. Similarly, such a comparison permits an assessment of which regions of the sequence are conserved and which are not, which may aid in determining those regions of the protein that are essential for the functioning of the Rfo proteins. This type of determination is of value for protein engineering studies and may give an indication of what the protein can tolerate in terms of mutagenesis without losing function.

Throughout this application, various publications are referenced. The disclosures of all of these publications and those references cited within those publications in their entireties are hereby incorporated by reference into this application in order to more fully describe the state of the art to which this invention pertains. It should also be understood that the foregoing relates to preferred embodiments of the present invention and that numerous changes may be made therein without departing from the scope of the invention. The invention is further illustrated by the following examples, which are not to be construed in any way as imposing limitations upon the scope thereof. On the contrary, it is to be clearly understood that resort may be had to various other embodiments, modifications, and equivalents thereof, which, after reading the description herein, may suggest themselves to those skilled in the art without departing from the spirit of the present invention and/or the scope of the appended claims.

EXAMPLES

Materials and Methods

Plant Growth, DNA Isolation, Marker Analyses and Library Construction

Radish plants were grown in growth chambers with a 16 hour photoperiod cycle, at 20° C. day and 15° C. night. To self-fertilize these plants, a bud that was about to open was teezed apart and its anthers and petals removed. An anther from another flower on the same plant was picked and used for pollination. The pollen was applied directly to the stigma. This procedure was repeated on 3 or 4 buds of the same branch. Any nearby open flowers were detached. A white paper crossing bag was used to cover the buds. The plants were then placed in a greenhouse to allow for seed maturation. Fresh leaf material was used for DNA extraction. DNA extraction, restriction enzyme digestion, Southern blotting and RFLP analysis were carried out according to Cheung W. Y. et al (1997, Theor Appl Genet 95:73–82). Small scale DNA preparations suitable for PCR analysis were according to Cheung W. Y., Hubert N., Landry B. S. (1993). PCR Methods Applic 3:69–70.

Genomic DNA from radish plants homozygous for the Rfo restorer locus was isolated, and BAC library construction and preparation of probes from BAC ends was according to Woo S S, Jiang J, Gill B S, Paterson A H, Wing R A (1994) Nucleic Acids Res 22: 4922–4931. High density colony filter of BAC clones were generated and screened according to the procedure of Clemson University Genomic Institute (Tomkins J P, Mahalingham R, Smith H, Goicoechea J L, Knap H T, Wing R (1999) Plant Mol Biol 41: 25–32). A genomic library from a radish plant homozygous for the restorer was constructed in the fosmid vector pFOS1 (New England Biolabs) according to the manufacturer's instructions. The library was screened by successive rounds of colony lifts as described in Sambrook et al (1989) Molecular Cloning: A laboratory Manual. $2^{nd}$ ed. Cold Spring Harbor laboratory Press, Cold Spring Harbor, N.Y.

BAC and Fosmid Sub-Cloning and Sequencing

BAC and fosmid DNA was isolated from exponentially growing *E. coli* (Electromax DH10B, Gibco) cells using a Qiagen Large-Construct Preparation Kit. The DNA was sheared to a size of approximately two to six kb with a Hydroshear (GeneMachines) according to manufacturer's recommendations. The ends of the sheared fragments were blunted using Gibco T4 DNA polymerase. The pBluescriptII phagemid (Stratagene) was used as a vector to sub-clone the blunted sheared DNA fragments. To prepare for ligation, the vector was digested with the restriction enzyme EcoRV (Amersham-Pharmacia Biotech) and dephosphorylated with Calf Intestine Phosphatase (CIP, New England Biolabs). The vector was then separated on a 0.7% agarose gel, excised and gel purified using the Sephaglas Kit (Amersham-Pharmacia Biotech). This digested, dephosphorylated and gel purified vector was ligated to the blunted sheared DNA fragments using the T4 DNA ligase (Gibco). After an overnight incubation at 16 deg. C, the ligation mixture was chemically transformed into *E.coli* (XL1-Blue, Stratagene) as described in The NEB Transcript 6: (1) 7. Recombinants plasmid DNA was isolated with an Autogen 740, restricted with BamHI-XhoI (Amersham-Pharmacia Biotech) enzymes and separated on 0.8% agarose gels to determine insert size. Isolated plasmids were also sequenced with Li-COR DNA sequencers LONG-READIR 4200 according to manufacturer's recommendations.

Assembly of BAC and Fosmid Sequences

Raw trace files were obtained in SCF format from one of ten Li-COR sequencers. Read lengths of approximately 800 bp were obtained for each of the forward and reverse strands from a particular clone. The trace files were collected in a single directory on a UNIX server. The Staden software package was installed and configured on a Sun 420R server.

Pregap4 was used to process the SCF files and generate EXP files, which were assembled into a contiguous sequence. Phred was used to produce a quality score for each base within each read. The raw sequence was clipped according to a minimum quality score of 15 as produced through the use of Phred. Cross match was used to screen out any contaminating cloning vector sequence. Similarly Cross Match was used to mask any sequencing vector found in the raw sequence. RepeatMasker was used to mask any region that contained repetitive sequence, which may skew the assembly process. Once processed, the resulting EXP files were assembled using the Phrap program. Assembly was performed with a minimum exact match value of 12 and a minimum SWAT score of 30.

The resulting assembly produced a preliminary sequence assembly, which was analyzed with the Gap4 software package. A minimum of five-fold coverage was deemed to be acceptable in considering a particular region of sequence completed and correct. The assembly was meticulously analyzed for incorrect and erroneous sequence position manually. Chimeric clones were discovered and removed. These were visible using the known insert size of a particular clone and comparing the position of the reverse and forward reads in the assembly. Primers were designed using the Oligo 6 software (Molecular Biology Insights) in regions that contained potential mismatches or discrepancies. PCR amplifications were performed, amplification products were cloned and the resulting sequences were assembled and the correctness of the sequence determined.

Further evidence of sequence correctness was provided by restriction enzyme profiles of the individual BAC and fosmid clones and the corresponding consensus sequence. The use Gap4 Software and the recognition sites for EcoRI, EcoRV and HindIII produced an expected pattern of size fragments. These were then compared to restriction analysis performed in the laboratory, which concurred the correct sequence.

Sub-Cloning and Plant Transformation

Constructs containing the Rfo genes of interest are introduced into *Brassica napus* as described below. *B. napus* seed are sterilized in 20% commercial bleach for 30 minutes with shaking. The seeds are then washed 5 times in a sterile funnel and filter paper with sterile distilled water. The seeds (~20 per plate) are placed on Bn I (seed germination medium, see below), wrapped in Parafilm and incubated at 25° C. for 5 days. *Agrobacterium* with the plasmid of interest is inoculated into 5 ml LB+Kanamycin 100 (100 mg/L)+Gentamycin 25 (25 mg/L) (for clones in pRD400 vector) or 5 ml LB+tetracyclin (2.5 mg/L)+Gentamycin 25 (25 mg/L) (for clones in pOCA18 vector) and incubated at 28° C. with shaking for 24 hours. 50 µL of this culture is transferred to 5 mL of LB with the appropriate antibiotics as decribed above and incubated at 28° C. with shaking for 24 hours. 5 mL of this culture is removed and recovered by centrifugation. The cell pellet is resuspended in 1 mL of MS media (no antibiotic), diluted 1:100 in MS media and used for plant transformation.

For transformation, the petiole of 4 to 5 day old *Brassica* cotyledons are cut with a sterile scalpel. The cut surface is dipped in the diluted *Agrobacterium* suspension for 1 second and the cotyledons on are placed on Bn II (co-cultivation) medium by pushing the petiole into the soft agar. 20 cotyledons are placed on each plate. The plates are wrapped in Parafilm and incubated for 3 days at 25° C. in a growth room under constant illumination. After 2 days, the cotyledons are transferred immediately to Bn IV (selection regeneration) medium if *Agrobacterium* growth around the petiole is noted. Otherwise, the cotyledons are transferred to Bn IV (selection regeneration) medium after 3 days. Upon transfer, the plates are sealed with Parafilm and incubated at 25° C. under constant illumination. Cotyledons are transferred to fresh plates after 7 days and again every 10 days after that. At this stage a maximum of 10 cotyledons are placed on each plate. Callus formation at the tip of the petiole occurs within several weeks.

At this time, bleached shoots are removed. Putative transgenic shoots that arise from the callus are green and may look vitrified. These are excised and transferred to Bn V shoot elongation medium. Attached calli are removed from the shoot. In Bn V media some shoots will develop roots at which point the plantlets can be transferred to soil. After several weeks on Bn V media, if the shoots have not developed roots, they are transferred to Bn VI (rooting) media. Once roots have formed, the plantlets can be transferred to soil. If rooting seems not to occur after several transfers, the plantlets may be put directly into soil.

If the *B. napus* seed used in the transformation procedure above was an ogu CMS line, the recovery of male fertile plants is indicative of the presence of the Rfo gene in the introduced DNA. The transgenic plant could also be screened for an ability to restore male-fertility by crossing the transgenic plant with a male-sterile plant and determining if the F1 generation hybrid is male-fertile. A determination as to whether male-fertility is restored in a plant can be made, for example, by 1) visually assessing an increase in the production of pollen as compared to a male-sterile plant or 2) determining that the plant can self-fertilize as evidenced by placing a bag over a flower on the plant and finding an increase of seed therein as compared to a male-sterile plant.

MEDIA

Bn I: Murashige-Skoog (MS) minimal medium (Sigma), 3% sucrose, pH 5.8

Bn II: MS, 3% sucrose, 4.5 mg/L Benzyladenine (BA), pH 5.8

Bn IV: MS, 3% sucrose, 4.5 mg/L BA, 20 mg/L Kanamycin (Km), 500 mg/L 300 mg/L Timentin (Tn), pH 5.8

Bn V: MS, 3% sucrose, 20 mg/L Km, 300 mg/L Tn, pH 5.8 Bn VI: MS, 3% sucrose, 2 mg/L Indole butyric acid (IBA), 300 mg/L Tn, pH 5.8.

All of the media contain 0.7% w/v phytagar.

LB: 10 g/L Tryptone, 5 g/L yeast extract, 10 g/L NaCl, pH 7.0

Analysis of Transgenic Plants

Individual transgenic plants were raised to maturity and visually assessed for male fertility/sterility. Small samples of leaf DNA were taken from the plants and analyzed by PCR using primers for specific genes and for the NPTII plant selection maker in the vectors. Gene 16 and Gene 26 transgenic plants were further analyzed for the vector copy number and integrity by Southern blot analysis. Only plants testing positive for the NPTII, introduced gene and orf138 are listed in Table 1.

RACE Analysis

Total RNA from fertile radish plants and fertile *Brassica* transgenic plants were extracted at flowering stage. The Gene specific primers were designed from the predicted exons of Genes 16 and Gene 26. A SMART™ RACE cDNA amplification kit (Clontech) was used to generate 5' and 3' RACE products. The PCR products were purified and sequenced directly.

Scientific Approach

A strategy termed positional or map-based cloning, that allows the identification and isolation of genes solely on the basis of the phenotype they confer, was employed to isolate these genes. This strategy is based on the principle of genetic mapping. Populations are developed in which the gene of interest, in this case the Rfo restorer gene, is segregating genetically. In the present example, mapping populations were developed by crossing a radish restorer line (a line that is homozygous for the Rfo locus) with a radish Ogura CMS line lacking the restorer gene (or homozygous for the recessive Rfo allele of the restorer locus). The resulting F1 generation plants were then self-fertilized to create F2 populations. Individual F2 plants heterozygous for the restorer gene were self-fertilized to create F3 populations. F4 and F5 populations were developed by self-fertilizing F3 and F4 plants, respectively.

Markers that detect differences in the original parent plants are used to track the chromosomal segments from each parent that are transmitted to the different progeny plants. In the current case, markers employed were DNA markers, which directly detect DNA sequence differences between the parental chromosomes. The restorer gene itself can be tracked by its phenotype; plants with the ogu male sterile cytoplasm that lack the restorer gene are male sterile (FIG. 1B) and possess small sterile stamens that are clearly distinguishable from those of male fertile plants with the ogu cytoplasm that contain the restorer gene (FIG. 1A). Rfo is a dominant gene, meaning that a plant need inherit only one copy of the Rfo locus to be male fertile; plants heterozygous for Rfo are indistinguishable from plants homozygous for Rfo. Plants lacking a copy of Rfo (or that are homozygous for the Rfo recessive allele) with the male sterile cytoplasm are sterile. Chromosomal maps can be generated that are based on the frequency with which the markers from a particular parent are co-inherited in progeny plants: the more frequently two markers are inherited together, the closer they are located to one another on the chromosome.

For markers very close to the restorer gene, at least one copy of the allele from the fertile parent will almost always be found in fertile plants. It is possible to genetically delimit the chromosomal region containing the restorer gene on this basis: if the corresponding segments of two homologous chromatids of a fertile plant each carry alleles from the sterile parent, that segment cannot contain the restorer gene. Similarly, if a chromosome segment in a sterile plant carries alleles of the fertile parent, that segment cannot contain the restorer gene.

The availability of DNA markers that are genetically tightly linked to a gene of interest is the starting point for a map-based cloning strategy. These markers are used to isolate genomic DNA clones, which may, in turn be used to select additional genomic clones. The individual clones so isolated are grouped into "contigs", sets of overlapping cloned DNA segments, until a single contig that spans the genomic region surrounding the gene of interest is assembled. By introducing the different portions of the cloned region or contig into plants of the appropriate genotype, and subsequently assessing the phenotype of these plants, it is possible to identify the specific portion of the contig that contains the gene. To characterize the gene, the sequence and expression of this specific portion is analyzed.

Genetic Localization of the Radish Rfo Locus

Figure 2:
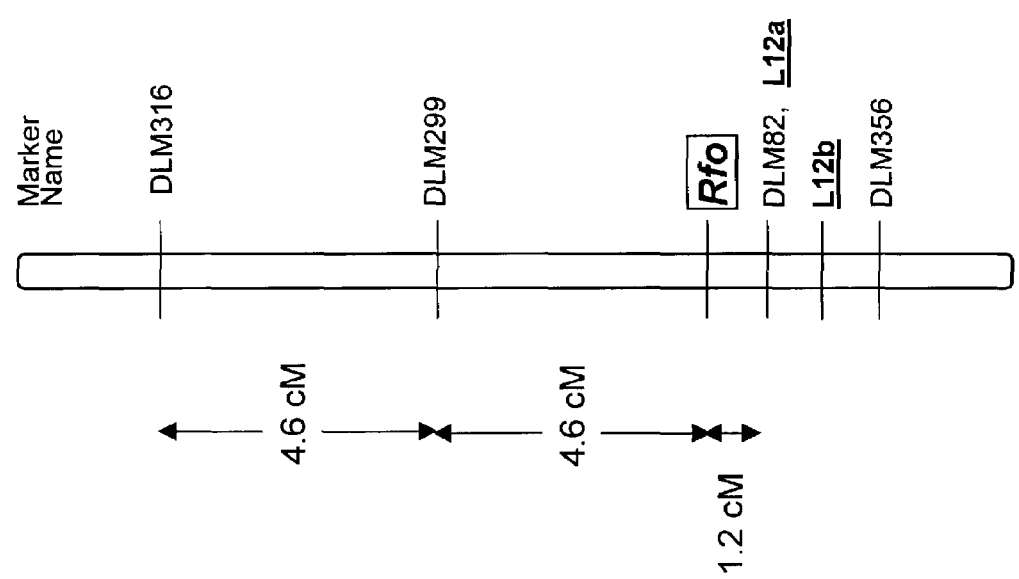
FIG. 2. Genetic mapping of the radish Rfo locus with respect to *B. napus* (black lettering) and *Arabidopsis* BAC derived probes (underlined). Genetic distance is indicated in centimorgans (cM).

Rfo mapping populations were developed using both Asian and European radish varieties. Initial studies indicated that B. napus RFLP markers that co-segregated with Rfo in B. napus crosses mapped up to 60 cM from one another in radish, consistent with the genetic distance separating these markers in B. napus crosses that do not involve Rfo (Delourme R, Foisset N, Horcais R, Barret P, Champagne G, Cheung W, Landry B S & Renard M (1998) Theor Appl Genet 97: 129–134). These mapping studies were extended by developing F3, F4 and F5 populations. One of the F4 populations (D26/44 F4) comprised 90 individuals and became the focus of subsequent analyses aimed at more extensive targeting and mapping of markers to the Rfo region. New Rfo-linked RFLP markers, identified by bulked segregant analysis (Michelmore R W, Paran I, Kesseli R V (1991) Proc Natl Acad Sci USA. 88:9828–9832.), were mapped on this F4 population. One marker, DLM82, was found to co-segregate with Rfo, while two others, DLM 299 and DLM316, were found to map within 4.6 and 9.2 cM of Rfo, respectively. Recombination between the DLM 82 marker and Rfo was detected through analysis of a second radish F4 population (D63/41 F4) of 89 individuals. The results from these mapping studies, summarized in FIG. 2, indicated that markers spanning the Rfo region had been identified.

A radish plant homozygous for Rfo-associated alleles of all markers in the Rfo region was used as the source of genomic DNA to construct a BAC genomic library suitable for cloning the gene. A library of 48,000 clones with an average insert size of 43 kb was generated and arrayed in 384-well microtiter plates. This library represents the radish genome at approximately 4-fold redundancy. To exploit the regional synteny between radish and Arabidopsis, Brassica/radish RFLP markers mapping close to Rfo were first hybridized to an Arabidopsis BAC library to identify corresponding Arabidopsis clones; these were then selected and a contig of overlapping Arabidopsis BACs was constructed using a BAC fingerprinting database. Markers derived from these BACs as well as radish RFLP markers mapping close to Rfo were used as probes to identify corresponding radish BAC clones. End probes from these Arabidopsis and radish BACs were then used to identify additional, overlapping BAC clones, and thereby extend the different contigs.

Clone DLM82 identified several BAC clones in the Arabidopsis library; end probes from one of these detected polymorphism between sterile and fertile radish bulks. Starting with this clone, it was possible to assemble an Arabidopsis contig of BACs, which represent the segment of the Arabidopsis genome extending from Chromosome 1 nucleotides 23,391,584 to 23,806,826 (F22C12-F13O11) (Arabidopsis sequence coordinates and BACs are listed on the Arabidopsis Genome Initiative website: http://www.arabidopsis.org/agi.html). End probes from clones of this region detected polymorphism between the radish bulks, indicating that synteny between radish and Arabidopsis was maintained in this region. An Arabidopsis BAC derived end probe L12 was found to hybridize to two polymorphic radish fragments; these fragments represent two linked but independent loci, L12a and L12b. One of these, L12a, co-segregated with B. napus marker DLM 82. Two recombination events were found to have occurred in the F4 mapping population between the L12a and L12b loci, with L12b being located distal to Rfo, between the B. napus RFLP markers DLM356 and DLM82. These results are summarized in FIG. 2. Probes derived from the ends of other Arabidopsis BACs were found to map within the interval defined by L12b and DLM82/L12a. Additional genetic mapping in radish of markers derived from this Arabidopsis contig, such as L40 (FIG. 3A) indicated that the physical location of the markers was consistent with their genetic position, and hence that co-linearity in this region between the Arabidopsis and radish genomes (radish regions rB1–rC and Arabidopsis B-C, FIG. 3A) was maintained.

One Arabidopsis marker located in the vicinity of L12, was found, like L12, to be duplicated in radish, suggesting that a portion of the syntenic Arabidopsis region is duplicated in the radish genomic region near Rfo (region rB2, FIG. 3A). Further analysis of the radish population using markers derived from the Arabidopsis BACs indicated a lack of synteny between radish and Arabidopsis for markers located to the right of L40 and suggested an inversion of markers in the duplicated region (region rB2, FIG. 3A). This further suggested that the genomic region in radish containing Rfo might correspond to the Arabidopsis region flanking the L12 sequence but distal to the L40 sequence (region A, FIG. 3B).

A chromosome walk from the opposite side of Rfo was initiated using the RFLP probe DLM299, which detects a small gene family in radish, only one member of which appears to be linked to Rfo. DLM299 was used to recover two radish BAC clones, from which derived probes detected differences between the bulked homozyogous fertile and sterile radish DNA, indicating linkage to Rfo. The sequences which comprise the DLM299 region recovered in this manner were found to be located within two radish BACs. Probes derived from these BACs were used to recover an additional set of radish BACs. Interestingly, an end probe from one of these additional BACs (64K20) mapped closer to Rfo than did DLM299.

Further localization of the Rfo locus was accomplished by developing and analyzing a European radish mapping population of 135 individuals, together with an F5 Asian radish population of 900 individuals. A radish BAC recovered using sequences from Arabidopsis region rB2 (11K10) was sequenced and used to derive a CAPs marker (Konieczny A, Ausubel F M (1993) Plant J 4: 403–410) to facilitate analysis of this large population. A CAPS marker was also derived using sequence information from BAC 64K10, which maps to the opposite side of Rfo. By screening small scale DNA preparations from all 900 individuals using these markers it was possible to identify individuals in which recombination had occurred in the vicinity of Rfo and which were therefore informative for more detailed mapping analysis. In addition, the radish BAC contigs were extended by using probes derived from Arabidopsis region A (roughly Chromosome 1 nucleotides 23,000,000 to 23,400,000 in the Arabidopsis genome; see FIG. 3B) to recover additional radish BACs.

Figure 4:
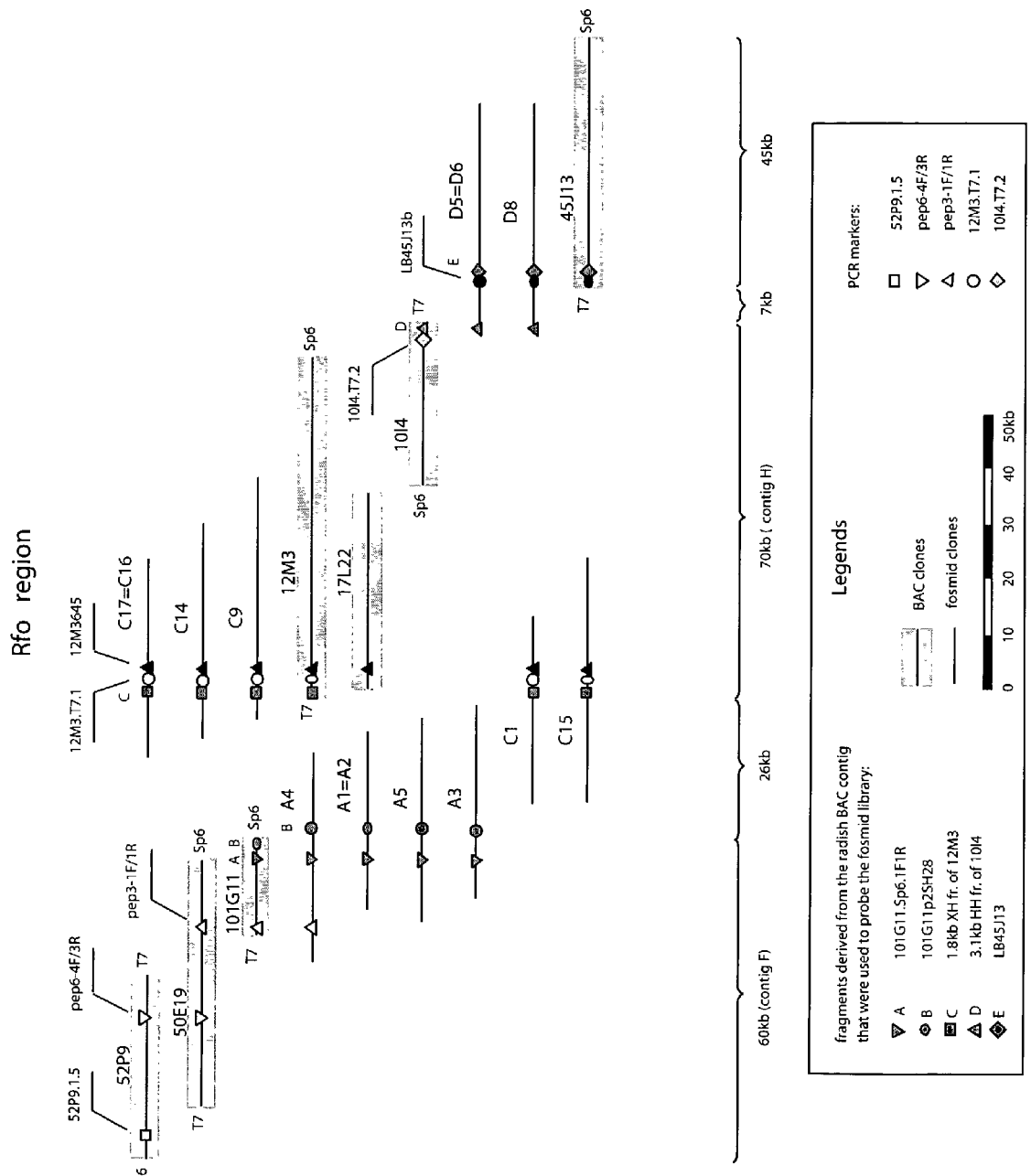
FIG. 4. BAC and cosmid contig spanning the Rfo containing region of the radish genome. The horizontal bars represent different the region contained in different clones; BAC clones are indicated by the shaded bars. The symbols on the bars (triangles, squares, circles etc.) indicate the position of different markers used in radish genetic mapping or clone recovery experiments.

These, together with radish BACs corresponding to region rB2, were used to recover more radish BACs and all these were assembled into contigs on the basis of overlapping restriction enzyme profiles. Gaps between the contigs were filled by recovering clones from a cosmid library of genomic DNA isolated from a plant known to be homozygous for the Rfo region. The physical relationship among the clones from a portion of this contig is shown in FIG. 4.

BAC and cosmid clones showing complete genetic linkage to Rfo were sequenced. In total, a sequence of over 270 kb, representing a minimum of 5-fold coverage of each genomic region, was assembled and annotated. The result of the sequence analysis of this Rfo region is provided in the Appendix as SEQ ID NO:87. The sequence was found to contain 43 putative (or predicted) genes. Those 43 putative gene products and genes, and gene products, are provided in the Appendix herein as SEQ ID NOS: 1–86.

The European radish population segregating for Rfo was found to be monomorphic for markers derived from the region containing genes 31 through 41 of the 270 kb sequence. Since this population segregated for the restorer gene, this observation delimited one boundary of the potential Rfo coding region and eliminated predicted genes 31 through 41 as candidates. This region was also eliminated by a sterile plant in the Asian F5 population, which was homozygous for the sterile parent alleles for markers in the region through gene 30, but heterozygous for an allele derived from gene 31. The Asian radish F5 population also contained a sterile plant that was homozygous for sterile parent alleles derived from the region extending from gene 16 through 30, but heterozygous for alleles from gene 9 through 15 (genes 1 through 9 were not examined). Accounting for the possibility of recombination within restriction fragments that define the RFLPs for these alleles, these observations indicated together that the Rfo locus resided within the region containing predicted genes 14 through 30.

Transformation of Genes from the Rfo Coding Region into Ogura CMS B. napus

Figure 5:
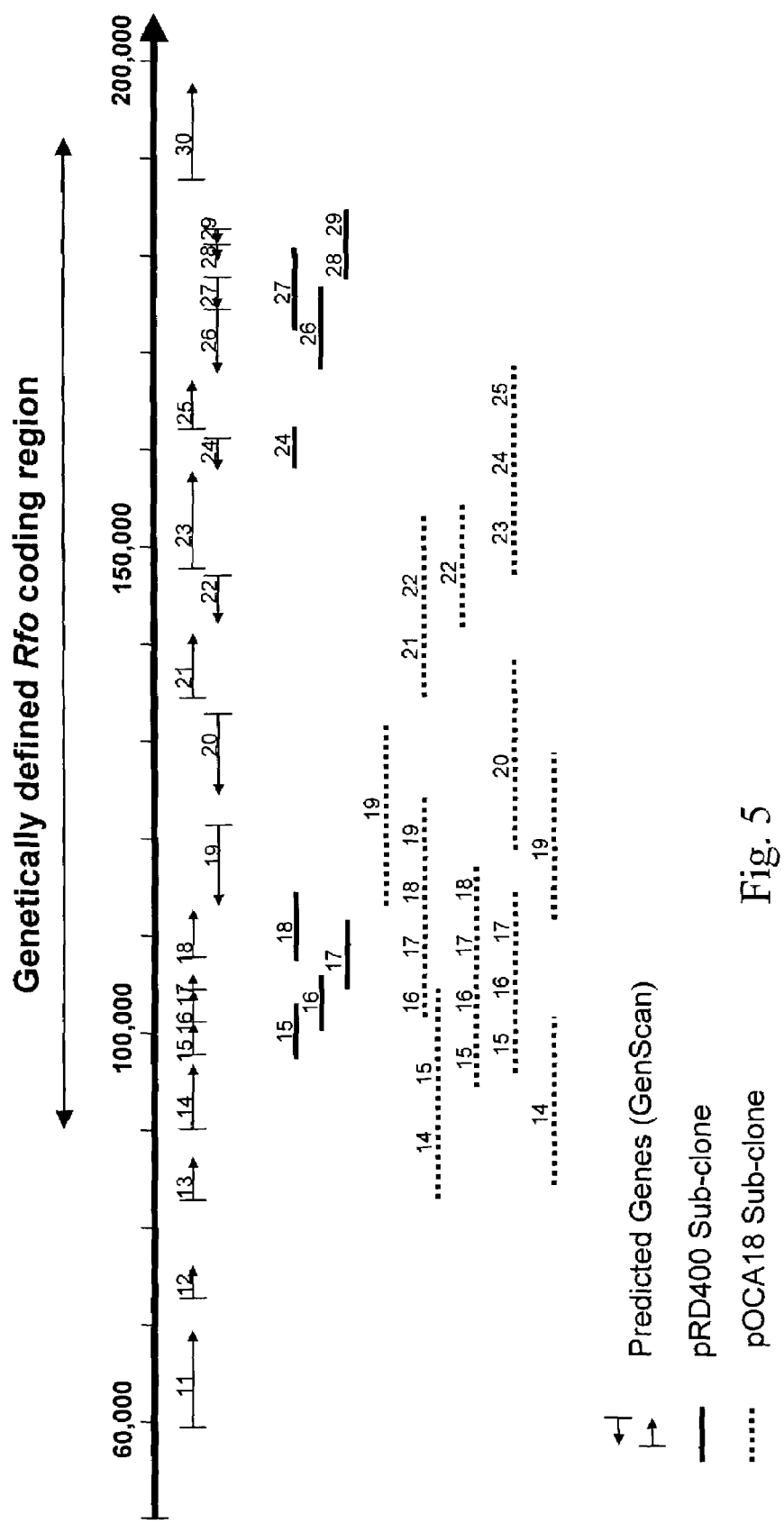
FIG. 5. Schematic representation of the annotation for the portion of the 270 kb radish genomic sequence containing the Rfo locus. The sizes and locations of different predicted genes within the region are indicated by the smaller arrows below the long arrow that depicts the corresponding numerical coordinates of the sequence. The arrows indicate the direction of transcription; for genes indicated by arrows pointing to the right, the sense strand sequence is given in the Appendix; for arrows pointing to the left, the sense strand sequence will be the reverse complement of that given in the Appendix. Sequences and genes contained in different pRD400 (solid lines) and pOCA18 (dashed lines) clones used for transformation are indicated beneath the annotation schematic.

Plant transformation experiments were conducted to determine the capacity of the various predicted genes to act as restorers of Ogura CMS in B. napus. This test was based on the premise that transformation of CMS plants with genomic DNA spanning a restorer gene should result in the recovery of male fertile transgenic plants. The genes were sub-cloned from clones, individually or in combination with flanking genes, into binary transformation vectors, and introduced into Ogura CMS B. napus plants by Agrobacterium-mediated transformation. The genes in the Rfo containing region and the various subclones used in transformation experiments are shown in FIG. 5. The region roughly corresponds to the region extending from the left end of clone 50E19 to the right end of clone 12M3 in FIG. 4.

The results of these transformation experiments are summarized in Table 1.

TABLE 1

Plant transformation results

| Construct | Vector | Gene(s) | Recovered plants | |
|---|---|---|---|---|
| | | | Fertile | Sterile |
| P12-33 | pRD400 | 14 | 0 | 1 |
| P11-92 | pOCA18 | 14, 15 | 0 | 1 |
| P1-Sh20 | pRD400 | 15 | 0 | 23[1] |
| P2-Sh31 | pRD400 | 16 | 2 | 5 |
| P24-Sh23 | pRD400 | 17 | 0 | 9[1] |
| P11-76 | pOCA18 | 16, 17, 18, 19 | 0 | 2 |
| P11-96 | pOCA18 | 15, 16, 17, 18 | 0 | 1 |
| P3-Sh8 | pRD400 | 18 | 0 | 2 |

TABLE 1-continued

Plant transformation results

| Construct | Vector | Gene(s) | Recovered plants | |
|---|---|---|---|---|
| | | | Fertile | Sterile |
| P1-11 | pOCA18 | 19 | 0 | 1 |
| P11-66 | pOCA18 | 20 | 0 | 4 |
| A4-112 | pOCA18 | 21, 22 | 0 | 1[2] |
| PEP-3 | pRD400 | 24 | 0 | 5 |
| Bgl-5 | pRD400 | 26 | 1 | 0 |
| KH8 | pRD400 | 28, 29 | 0 | 1 |

[1]Two of these plants had a few branches with fertile flowers.
[2]Plant had some fertile and some sterile flowers.

Figure 6B:
FIGS. 6A and 6B. Flowers of the *Brassica napus* Ogura CMS line used in transformation experiments (6A) and a T0 transgenic plant transformed with the contruct P2-Sh31, containing Gene 16 (6B). Note the poorly developed stamens and anthers in the CMS line and the larger, normal, fertile stamens and anthers in the transgenic Gene 16 fertility restored plant. Note too the yellow petal color of *B. napus* flowers in comparison to the white petals of radish flowers. Flowers of the fertile plant recovered from transformation with the Bgl-5 construct containing Gene 26 are identical in appearance to those of the Gene 16 transformants.
Figure 6A:
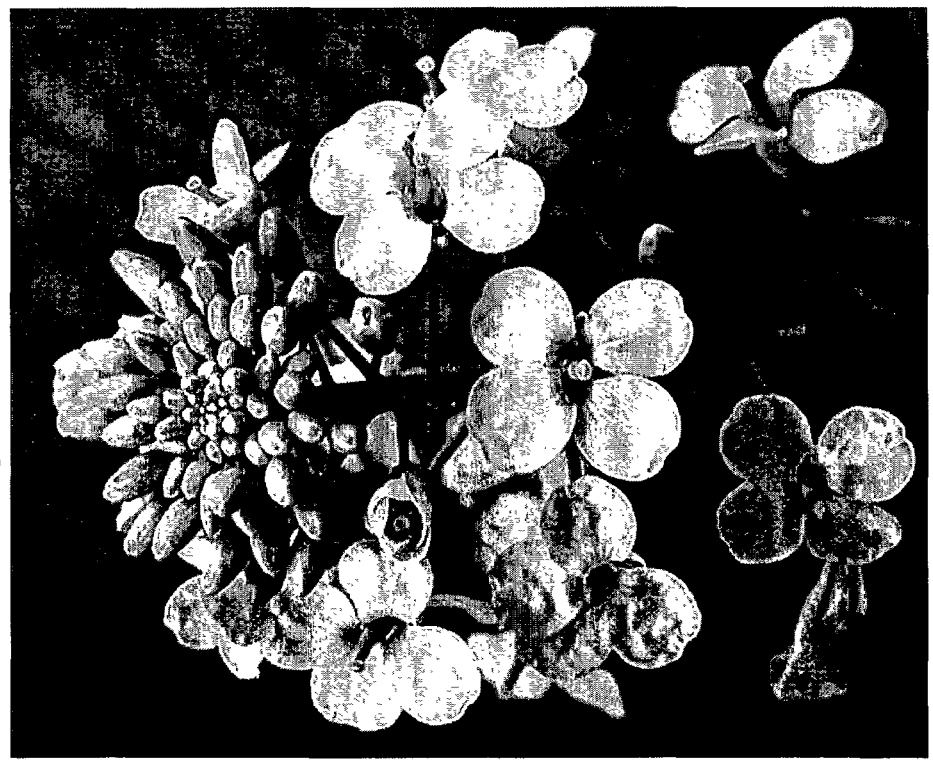

Completely male fertile plants were recovered following transformation with clones P2-Sh31 and Bgl-5, which contain the predicted genes, Gene 16 and Gene 26, respectively (FIG. 6). These male fertile plants showed no phenotypic alterations apart from the change in floral phenotype from Ogura CMS (left panel, FIG. 6) to the completely male fertile transgenically restored phenotype (right panel, FIG. 6). The transgenically restored flowers were indistinguishable from normal male fertile B. napus flowers. These observations indicate that Genes 16 and Gene 26 can each be used to derive new restorer lines from Ogura CMS lines that will be free from phenotypic abnormalities, including the high seed glucosinolate character.

Partially male fertile plants in which one or more branches contained male fertile flowers were recovered in transformants with three other constructs. Interestingly, one of these constructs (p1-Sh20) contained a gene that showed a high degree of similarity with Gene 16 (Gene 15, see below), while another (P24-Sh23) overlapped with P2-Sh31 and contained a portion of the Gene 16 coding sequence (see below). Only completely male sterile plants were recovered with most of the introduced cloned DNAs. All the transgenic plants recovered in these experiments were analyzed by PCR using primers specific for the introduced gene or genes, the NPTII transformation marker, and the mitochondrial gene orf138, which is unique to the Ogura male sterile cytoplasm.

Only plants that tested positive for all the transgenic sequences are listed in Table 1. For the Gene 16 and Gene 26 plants, these PCR analyses were confirmed by Southern blot analysis. Southern blot analysis also indicated that the fertile Gene 16 plants had two different transgene insertion events, each of which contained one or two copies of the introduced genes. Southern analysis of the fertile Gene 26 plant indicated that it had one transgene insertion site. For all completely fertile transformants additional PCR tests confirmed that borders of the inserted sequence were intact and matched those in the vector. Male fertile flowers of the plants were capable of setting seed upon selfing, and hence were female, as well as male, fertile.

The specificity of the orf138 primers was examined by testing their capacity to amplify a product from normal male fertile B. napus plants. No such product was observed in plants without the Ogura cytoplasm. This shows that the male fertile character of the Gene 16 and Gene 26 transformants, from which an orf138 PCR product was obtained indicating the presence of the Ogura cytoplasm, is not due to an artifact arising from contaminating male fertile cytoplasm seeds in the seed lot used to generate the explants for the transformation experiments. To rule out the possibility that mtDNA rearrangements involving only a portion of the mtDNA might be responsible for the male fertility of the Gene 16 transformed plants, the floral mtDNAs of these plants were isolated and further analyzed by restriction enzyme digestion. The mtDNA restriction digestion pattern was identical to that of the Ogura CMS parental plants used for the transformation experiments, (data not shown) indicating that no such rearrangement took place during the transformation/regeneration process. Collectively, the analysis of the plants transformed with different portions of the potential Rfo coding region indicates that at least two genes in this region are each capable of fully restoring fertility to Ogura CMS *B. napus* plants, Gene 16 and Gene 26, as defined herein.

Characterization of Gene 16

Figure 7B:
FIGS. 7A and 7B. Left Panel: RT-PCR products generated using an oligo dT adapter primer and a primer internal to the Gene 16 open reading frame (3' RACE) from total floral RNA of restored fertile (lane 4) and ogu CMS (lane 5) radish plants. Lane 1: DNA size markers (1Kb DNA ladder). Lanes 2 and 3 are RT-PCR products from controls provided with the 3' RACE kit. Lane 6 is gene-specific positive control. Right panel: 5' RACE products generated from total RNA of restored fertile (lane 4) and ogu CMS radish (lane 5) plants using a primer internal to the Gene 16 open reading frame and an adaptor primer for the 5' end. Lanes 1, 2, 3 and 6 are the equivalents of those in the left panel.
Figure 7A:
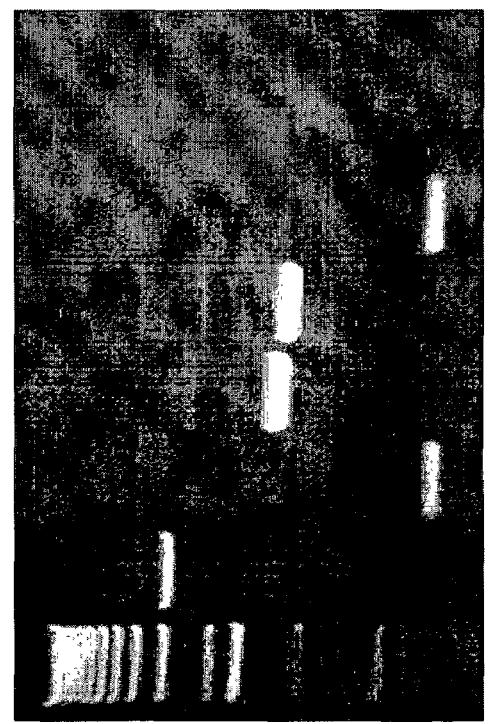

The annotation of the approximately 270 kb sequence (SEQ ID NO:87) obtained using the program GenScan revealed the presence, in the region contained on construct P2-Sh31, of a putative open reading frame starting at nucleotide 103,375 and extending to nucleotide 105,589, with a single intron extending from nucleotides 104,498 to 104,588. This Gene 16 ORF (SEQ ID NO:32) is predicted to encode a protein of 707 amino acids (SEQ ID NO:31). To confirm the gene prediction, 5' and 3' Rapid Amplification of cDNA Ends (RACE) analyses were performed on RNA isolated from radish plants homozygous for either the fertile or sterile alleles of genes throughout the entire Rfo region, including Gene 16. These analyses allowed identification of the sequences present in a full length cDNA of Gene 16 and hence unambiguous assignment of intron locations and the 5' and 3' mRNA ends. A single product was obtained from both the sterile and fertile allele plants with both 5' and 3' RACE (FIG. 7). The 5' RACE products of the sterile and fertile alleles were similar in size, whereas the 3' RACE product from the sterile allele was slightly smaller than the corresponding product from fertile plants.

Figure 8:
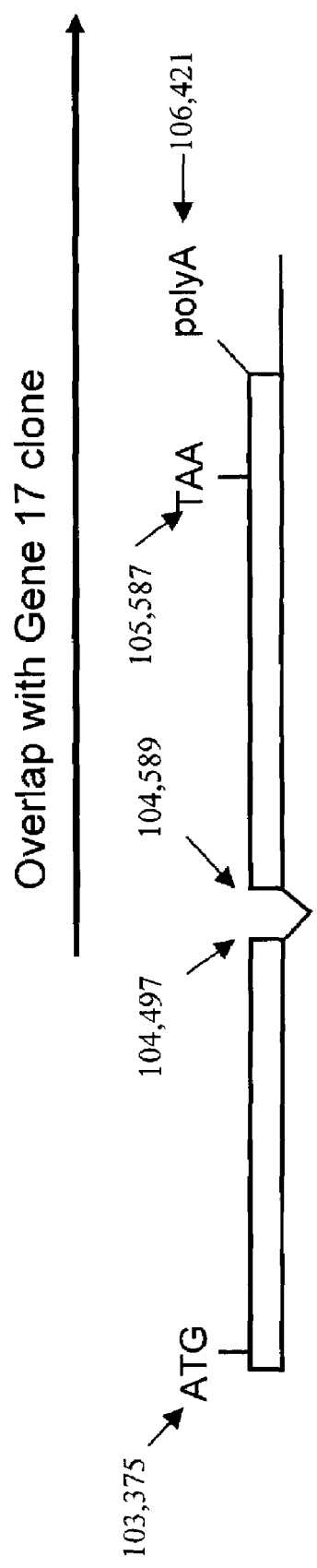
FIG. 8. Schematic depicting the structure of Gene 16 mRNA. Exons are indicated by boxes and intron positions and sizes by the diagonal lines connecting the exon boxes. Positions of the start (ATG), stop (TAA) and polyadenylation sites are numbered with reference to the Sequence shown in SEQ ID NO:87.

DNA sequence analysis of the fertile allele products indicated that the 5' end of the mature Gene 16 RNA mapped at or around nucleotide 102,847, and that the 3' end mapped at nucleotide 105,837. Sequence analysis of RT-PCR products confirmed the presence of the predicted intron and also revealed the presence of an additional intron upstream of the start codon that extended from nucleotides 103,036 to nucleotide 103,353. The structure of the Gene 16 mRNA is illustrated in FIG. 8. This Figure also illustrates the overlap between the Gene 16 clone and the adjacent clone (P24-Sh23) used in transformation experiments that gave rise to two plants with some male fertile flowers.

Figure 10:
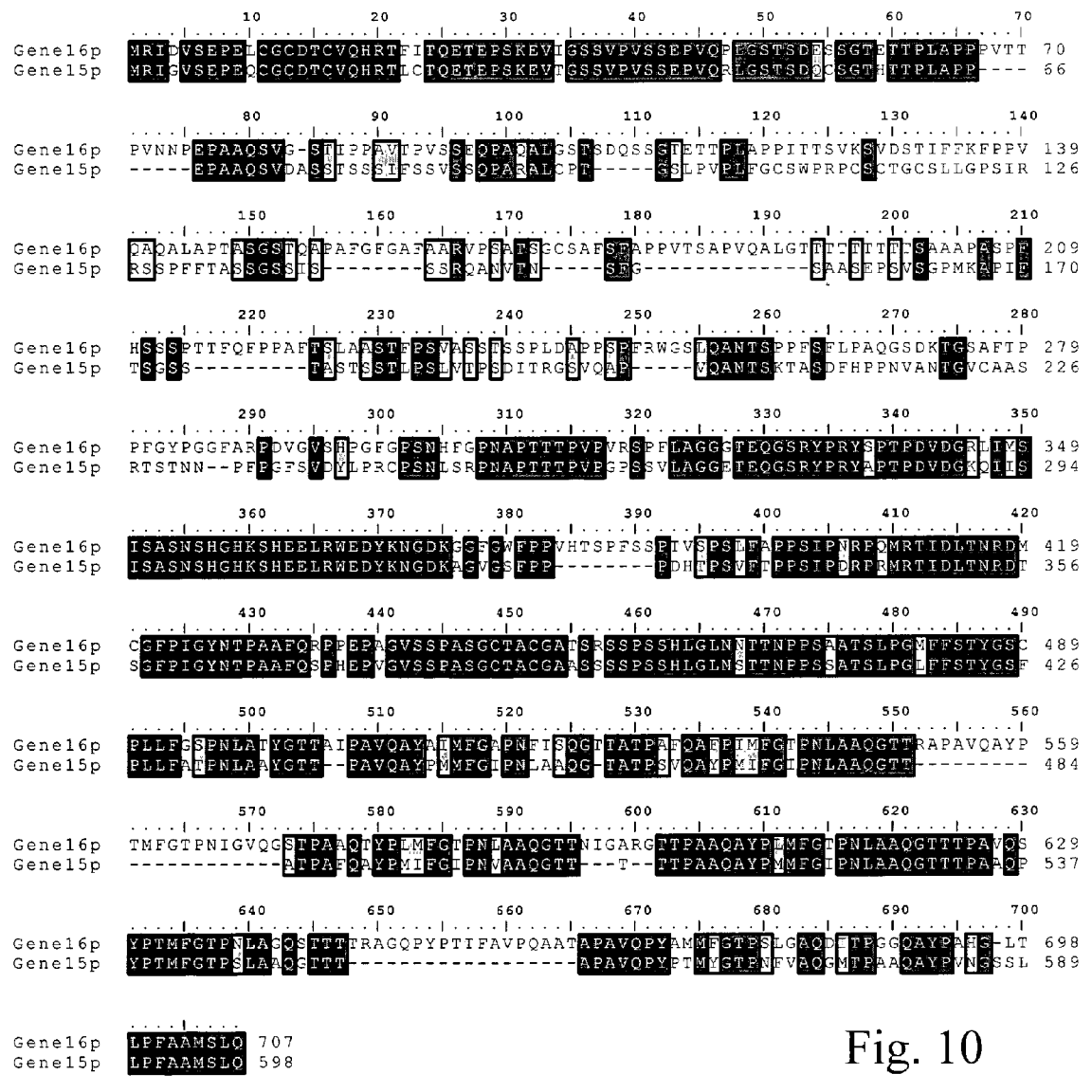

The predicted amino acid sequence of the Gene 16 polypeptide (Gene16p) product is identical to that provided in the Appendix (SEQ ID NO:31), since the ATG start codon lies downstream of the first, unpredicted intron, and is shown in FIG. 9. The polypeptide shows a relatively high degree of sequence similarity to the Gene 15 product (FIG. 10) (SEQ ID NO:29), and lower degrees of similarity with its *Arabidopsis* ortholog (F2K11.10) and the ortholog of Gene 15 (F2K11.11), as well as two paraloguous sequences in the *Arabidopsis* genome (F14N23.29 and T30E16.23). The biological functions of the *Arabidopsis* genes and proteins are not known. The similarity with these putative plant proteins lies mainly towards the C terminus.

Because the products of restorer genes are expected to act in the mitochondria, Gene16p for the presence of a potential mitochondrial transit peptide was analyzed (targeting presequence) using the program MitoProtII. This analysis indicated that the N terminal region of Gene 16 could function as a mitochondrial targeting site, but the probability associated with this was relatively low (approx. 20%). However, if translation started at a different methionine residue (residue 419) the N terminus of the resulting product would have a high probability of serving as a mitochondrial targeting presequence (95%). Other examples where the products of alternate translation inititiation events are targeted to different sub-cellular sites, including mitochondria, are known (Martin N and Hopper A K (1994) Biochimie 76: 1161–1167). It is also possible that the mitochondrial targeting information is located at an internal site in the Gene16p, since there are also examples of mitochondrial targeting sequences that are located in the interior of polypeptides instead of at the N terminus (Schricker R et al, (2002) J Biol Chem in press).

Collectively these analyses indicate that Gene 16 encodes a protein that resembles a protein encoded by the adjacent Gene 15 on the radish genome and, to a lesser degree, a small family of proteins in the encoded by genes in the *Arabidopsis* genome. It should be noted that some fertile flowers were observed on two plants transformed with the Gene 15 construct (Table 1), suggesting that this structural homolog can, to a more limited degree, functionally overlap with Gene 16 in its capacity to restore male fertility in Ogura CMS *B. napus* plants.

A thirty-two amino acid domain was found twice near the N-terminus of gene 16 and was found also once in gene15. A domain with the consensus "GTPNLAAQGTT_xTPAxQxYPxMF" (SEQ ID NO:91) was found repeating tandemly nine times in gene 16 and seven times in gene 15 near the carboxy terminus of the respective gene products. A summary of the two types of repeat domains found in the products of gene 16 and gene 15 with their consensus sequences and the locations of the repeats in the repective gene products is summarized in Table 2.

TABLE 2

| Domain consensus | Gene | Domain sequences | Location (Amino acid #) |
|---|---|---|---|
| PVSSE_PxQxLGSTSDxSS GTETTPLAPP_xTT (SEQ ID NO:92) | 16 | PVSSEPVQPLGSTSDESSGTETTPLAPPPVTT (SEQ ID NO:93) | 39–70 |
| | 16 | PVSSEPQPAQALGSTSDQSSGTETTPLAPPITT (SEQ ID NO:94) | 93–124 |
| | 15 | PVSSEPVQRLGSTSDQCSGTHTTPLAPP (SEQ ID NO:95) | 39–66 |
| GTPNLAAQGTT_xTPAxQ xYPxMF (SEQ ID NO:96) | 16 | GSPNLATYGTTAIPAVQAYAIMF (SEQ ID NO:97) | 494–516 |

TABLE 2-continued

| Domain consensus | | Gene Domain sequences | Location (Amino acid #) |
|---|---|---|---|
| | 16 | GAPNFTSQGTTATPAFQAFPIMF (SEQ ID NO:98) | 517–539 |
| | 16 | GTPNLAAQGTTRAPAVQAYPTMF (SEQ ID NO:99) | 540–562 |
| | 16 | GTPNIGVQGSTPAAQTYPLMF (SEQ ID NO:100) | 563–583 |
| | 16 | GTPNLAAQGTTNIGARGTTPAAQAYPLMF (SEQ ID NO:101) | 584–612 |
| | 16 | GTPNLAAQGTTTPAVQSYPTMF (SEQ ID NO:102) | 613–624 |
| | 16 | GTPNLAGQSTTTTRAGQPYPTTF (SEQ ID NO:103) | 625–647 |
| | 16 | AVPQAATAPAVQPYAMMF (SEQ ID NO:104) | 648–665 |
| | 16 | GTPSLGAQDITPGGQAYPA (SEQ ID NO:105) | 666–686 |
| | 15 | ATPNLAAYGTTPAVQAYPMMF (SEQ ID NO:106) | 431–451 |
| | 15 | GIPNLAAQGTATPSVQAYPMIF (SEQ ID NO:107) | 452–473 |
| | 15 | GIPNLAAQGTTATPAFQAYPMIF (SEQ ID NO:108) | 474–496 |
| | 15 | GIPNVAAQGTTTTTPAAQAYPMMF (SEQ ID NO:109) | 497–520 |
| | 15 | GIPNLAAQGTTTPAAQPYPTMF (SEQ ID NO:110) | 521–542 |
| | 15 | GTPSLAAQGTTTAPAVQPYPTMY (SEQ ID NO:111) | 543–565 |
| | 15 | GTPNFVAQGMTPAAQAYPVNG (SEQ ID NO:112) | 566–586 |

X indicates possible substitutions of various amino acids and _indicates site of possible insertion of one or multiple amino acids.

Characterization of Gene 26

Figure 11:
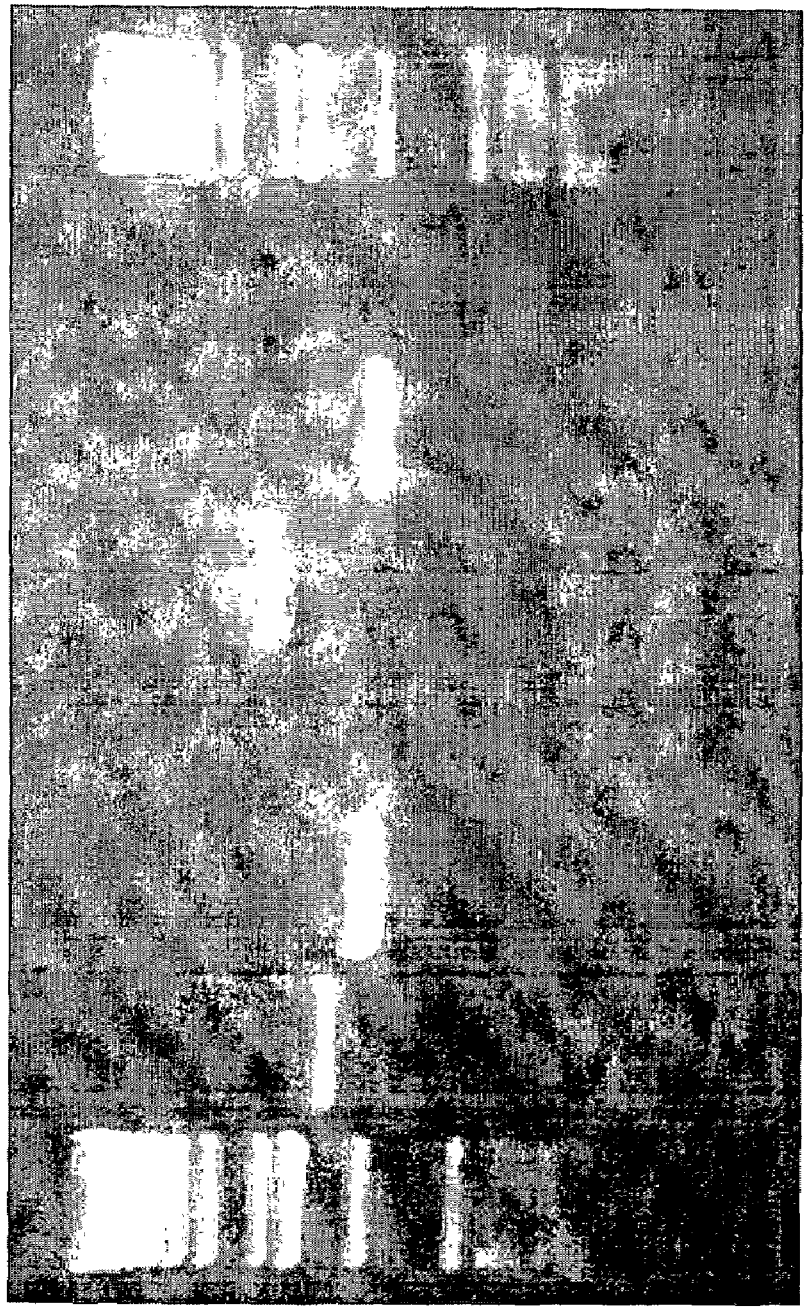
FIG. 11. 5' RACE products generated from total RNA of restored fertile (lane 2) radish plants using a primer internal to the Gene 26 open reading frame and an adaptor primer for the 5' end. Lane 3 is a gene-specific positive control. RT-PCR products generated using an oligo dT primer and a primer internal to the Gene 26 open reading frame (3' RACE) from total floral RNA of restored fertile (lane 5) radish plants. Lanes 1 & 8: DNA size markers (1Kb DNA ladder). Lane 6: an RT-PCR product for a control provided with the 5' RACE kit. Lanes 4 and 7 demonstrate that no product is generated when the adaptor primer for the 5' end or the oligo dT adaptor primer was omitted from the reactions respectively.

The GenScan annotation indicated the presence of a putative open reading frame on the strand complementary that in the Appendix (SEQ ID NO:87) that extends from nucleotides 173,669 to 167,079, with introns extending from nucleotides 173,613 to 171,029; 170,894 to 169,686; and 167,581 to 167,198. This region is contained within the Bg1-5 construct. The Gene 26 ORF predicted to encode a protein of 804 amino acids (SEQ ID NO:51). To confirm the gene prediction, 5' and 3' RACE analyses were performed on RNA isolated from radish plants homozygous for either the fertile or sterile alleles of genes throughout the entire Rfo region, including Gene 26. A single product was obtained from fertile allele plant RNA using both 5' and 3' RACE (FIG. 11); neither a 5' nor a 3' RACE product could be amplified from sterile allele plant RNA (not shown).

Figure 12:
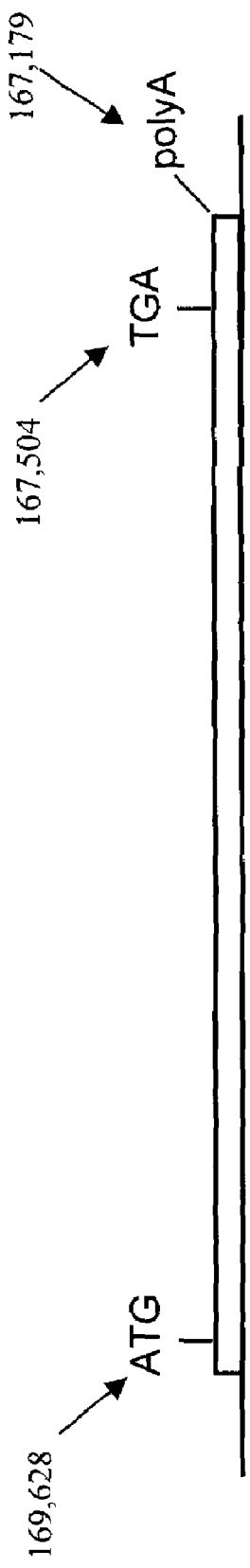
FIG. 12. Schematic depicting the structure of Gene 26 mRNA. Translation start and stop sites and polyadenylation site are as indicated in FIG. 8.

The structure of gene 26 mRNA as deduced from the analysis of RT-PCR products is illustrated in FIG. 12. Sequence analysis of 5' RACE product indicated that the 5' of the Gene 26 mRNA mapped near nucleotide 171,000 and that the 3' end mapped at or near nucleotide 167,000. The mature mRNA lacks the second intron sequence indicating this sequence is removed by RNA splicing. The sequence of the third predicted intron was found within the mRNA. As a result, the mRNA encoded peptide is 707 instead of 804 amino acids in lengths. FIG. 13 depicts the polypeptide (SEQ ID NO:88) encoded by the newly defined Gene 26 ORF (SEQ ID NO:89). The N-terminus of Gene 26p is predicted to function as a miotchondria targeting presequence with a likelihood of over 98% that Gene 26p is directed to the mitochondria. Gene 26 contains 15 repeats of a 35 amino acid consensus sequence, the pentatricopeptide or PPR motif VTYNSLISGYCKAGKLEE-ALELFKEMKEKGIKPDV (SEQ ID NO:90) Small I D & Peters N (2000) Trends Biochem Sci 25: 46–47). The sequences of the repeated domain (PPR (pentatricopeptide repeats) and their locations in gene 26 product are summarized in Table 3.

TABLE 3

| Domain consensus | Gene | Domain sequences | Location (Amino acid #) |
|---|---|---|---|
| VTYNSLISG YCKAGKLEE | 26 | YSFNILIKCFCSCSKLPFALSTFGKITKLGLHPDV (SEQ ID NO:114) | 115–149 |
| ALELFKEMK EKGIKPDV | 26 | VTFTTLLHGLCVEDRVSEALDFFHQMFETTCRPNV (SEQ ID NO:115) | 150–184 |
| (SEQ ID NO:113) | 26 | VTFTTLMNGLCREGRIVEAVALLDRMMEDGLQPT (SEQ ID NO:116) | 185–218 |
| | 26 | ITYGTIVDGMCKKGDTVSALNLLRKMEEVSHIIPNV (SEQ ID NO:117) | 220–255 |
| | 26 | VIYSAIIDSLCKDGRHSDAQNLFTEMQEKGIFPD (SEQ ID NO:118) | 256–289 |
| | 26 | FTYNSMIVGFCSSGRWSDAEQLLQEMLERKISPDV (SEQ ID NO:119) | 291–325 |
| | 26 | VTYNALINAFVKEGKFFEAEELYDEMLPRGIIPNT (SEQ ID NO:120) | 326–360 |
| | 26 | ITYSSMIDGFCKQNRLDAAEHMFYLMATKGCSPN (SEQ ID NO:121) | 361–394 |
| | 26 | ITFNTLIDGYCGAKRIDDGMELLHEMTETGLVADT (SEQ ID NO:122) | 396–430 |
| | 26 | TYNTLIHGFYLVGDLNAALDLLQEMISSGLCPD (SEQ ID NO:123) | 432–464 |
| | 26 | VTCDTLLDGLCDNGKLKDALEMFKVMQKSKKDLDASHPFNGVEPDV (SEQ ID NO:124) | 466–511 |
| | 26 | TYNILISGLINEGKFLEAEELYEEMPHRGIVPDT (SEQ ID NO:125) | 513–546 |
| | 26 | ITYSSMIDGLCKQSRLDEATQMFDSMGSKSFSPNV (SEQ ID NO:126) | 547–581 |
| | 26 | VTFTTLINGYCKAGRVDDGLELFCEMGRRGIVAN (SEQ ID NO:127) | 582–615 |
| | 26 | ITYITLICGFRKVGNINGALDIFQEMISSGVYPDT (SEQ ID NO:128) | 617–651 |

The PPR motif is found in other nuclear-encoded regulators of organelle gene expression in both fungi and plants (Fisk D G et al (1999) EMBO J 18: 2621–2630; Coffin J W et al (1997) Curr. Genet 32:273–280; Manthey G M and McEwen J E (1995) EMBO J. 14, 4031–40) and PPR protein-encoding genes represent a large gene family in the Arabidopsis genome (Aubourg et al (2000) Plant Mol Biol 42: 603–613). The predicted mitochondrial localization of Gene 26p and the presence of multiple PPR domains within it are consistent with its role in regulating the expression of the orf138 ORF associated with Ogura CMS.

The above example provides evidence that multiple genes within the sequence listed in the Appendix as SEQ ID NO:87 can function as fertility restorer genes. These experiments, however, do not exclude the possibility that other genes within the region can also function as restorer genes. For example, two partially fertile plants were obtained after transformation with the Gene 15 (SEQ ID NO:30) construct. Thus Gene 15, like Gene 16, may be able to function as a restorer gene. Similarly, two partially fertile plants were recovered after transformation with the Gene 17 (SEQ ID NO:34) construct, although in this case, the restoring factor may have been derived from expression of the portion of Gene 16 included in the Gene 17 transformation construct. A plant transformed with a construct containing Gene 21 (SEQ ID NO:42) and Gene 22 (SEQ ID NO:44) also produced some fertile flowers. Gene 24 (SEQ ID NO:48), Gene 26 (SEQ ID NO:52) and Gene 27 (SEQ ID NO:54) also contain PPR domains and are therefore expected to restore fertility phenotype according to the present invention. As discussed above, the preliminary analysis indicated that the restorer functions are most preferably located between Gene 14 and Gene 30 within the Rfo region as shown in the Appendix.

There are several reasons why not all of the transformants recovered following transformation with a specific construct necessarily show the same phenotype. The expression of the genes encoded in a specific construct may vary depending on the site of insertion, the number of copies of the gene at each insertion site, and other factors such as transgene silencing. Therefore, it is apparent that other genes in the genetically defined Rfo containing region can likely be found in view of the present disclosure to function as genes that confer complete fertility restoration. Given that Rfo maps as a single genetic locus in radish, the invention provides that two or more different genes in the region are able to function as restorer genes for Ogura CMS in B. napus.

SEQUENCE LISTING (128 sequences)

SEQ ID NO: 1 - protein, 405 aa, Raphanus sativum
MCKPNVVTFTTLMNGLCREGRVVEAVALLDRMVEDGLQPNQITYGTIVDGMCKMGDTVSALNLLRKMEELSHIKPDVVIYSAIIDGLWKDGRHTDAQNLFIEMQDKGIFPDIVTYSCMINGFCSSGKWSEAQRLLQEMLVRKISPDVVTFSGLINALVKEGDLNSAQDLLQEMISSGVCPNVVTCNTLLDGLCDRGKLKDALEMFKAMQKSMMDIDATHAFNGVEPDVQTYNILISGLINEGKFLEAEELYEEMPHRGIVPDTVTYSSMINGLCKQSRLDEATQMFDSMGSKSFSPNIVTFNTLITGYCKAGMVDDGLELFCEMGRRGIVANAITYITLIRGFRKVGNINGSLDIFQEMISSGVYPDTITIRNMLTGLWSKEELKRALAMLEELQMSMVSFMRLL

SEQ ID NO: 2 - DNA, 1218 bp, Raphanus sativum
atgtgtaaaccaaatgtcgtaaccttcaccacgctgatgaacggtctttgccgcgagggtagagttgtcgaggccgtagctctgcttgatcggatggtagaagatggtctccagcctaaccagattacttacggaacaattgtagatgggatgtgtaagatgggagacactgtgtctgcattgaatcttctgaggaagatggaggagttgagccacatcaaaccggatgtggtaatctatagtgccatcattgatggcctttggaaagacggacgtcataccgatgctcaaaatcttttcattgaaatgcaagacaagggaatctttccagatatagttacctacagctgtatgattaatggattttgtagctctggtaaatggagtgaagcccagcgcttgttgcaagaaatgttagtaaggaagatcagccctgatgttgtaactttcagtggattgatcaatgcattggtcaaagagggcgatcttaattctgctcaagaccttttacaggagatgatttctagtggtgtgtgccctaatgtcgttacttgtaacactttgctggacggtctctgcgatcgcgggaaactaaaagatgcattggaaatgtttaaggctatgcagaagagtatgatggacattgatgctactcatgccttcaatggtgtggaacctgatgttcaaacttacaatatattgatcagcggattgattaatgaagggaagtttttagaggccgaggaattatacgaggagatgccccacaggggtatagtcccagatactgttacctatagctcaatgatcaatggattatgcaagcagagtcgcctagatgaggctacacaaatgtttgattcgatgggtagcaagagcttctctccaaacatagtgacatttaacacactcattactggctactgtaaggcaggaatggttgatgacgggctggagcttttctgcgagatgggtcgaagagggatagttgctaatgcaattacttacatcactttgattcgtggttttcgtaaagtgggtaatattaatgggtctctagacattttccaggagatgatttcaagtggtgtgtatcctgataccattactatccgcaatatgctgactggtttatggagtaaagaggaactaaaaagggcactggcaatgcttgaggaactgcagatgagtatggtatcctttatgcgtctattgtag

SEQ ID NO: 3 - protein, 133 aa, Raphanus sativum
MISSLTHMGADKAGRNQYEEEEKEEEDGIRAITLSGSNLGATMKTELDDNHGDSYKNGGQELDFLTTFVNSNFQAVNNSIMMGAKYETHDPGVHLDISGDVEKPLMKAPGRGWRERKGKTQARRDRRESEHTD

SEQ ID NO: 4 - DNA, 402 bp, Raphanus sativum
atgatctcctccttaacccacatgggagcagacaaggcaggacggaaccaatatgaagaagaggagaaggaggaggaggatggcatcagagccatcacgctctctggatccaaccttggagccaccatgaagaccgagcttgatgataaccatggagacagctacaaaaacggtgggcaagagcttgatttcctgaccacttttgtaaacagcaactttcaagctgtgaacaactccataatgatgggcgcaaagtacgagactcatgatccaggagttcatcttgatatctcaggcgatgtggagaaacctttgatgaaggcacctgggagggggtggagggaaaggaaagggaaaactcaagctagaagagatcgtcgagaatctgaacatacagattga

SEQ ID NO: 5 - protein, 784 aa, Raphanus sativum
MTSLFSKARALTSLGSYFKTYRPVTGKLHVATLTLLLFLLAAAVAVTSSLWLSKTTKQFDTPTLVTRKPVPELESPKKTGVLVNGTSLLNQNRSGSYSETSLWLNKTKSYNQPTIITTKPVHVPVPVPEKKSTKKTGISVDCTSFLNQNRSGSCSRTAQPGYNNNQTESNRSCPDYFKWIHEDLKPWRETGITREMVERGQTTAHFRLVIVNGKVFVENYKKSIQTRDEFTLWGILQLLRKYPGKLPDVDLMFDCDDRPVIRLDGYSKSNHTAENAPPALFRYGGDRWTADVVFPDWSFWGWQEINIKPWSKVLTEMEKGKKKKKFMEREAYAYWKGNPFVASPSREDLLTCNVSSQHDWNARIFIQAQEIGRGASEFMQRDLSMENVYDYMFHLLNEYSKLLKFKPQVPQNSVEICTEAMVCPSGDANDTNKRFLMGSLVDEPHNSGPCSLPPPFDPNGLEKFYRKKLNLIRQVEKWEHAYWENHRSRSNIGLTFYRTRRTKLERIRKYRFRSESMLKYLLDLFYGDPQVSVWIYVLQETQSGIRNTQKLLYIRKKYKTTLYMRFKHRSRSNIGLTFYRTRRTKLERIRKYRFRSESMLKYLLDLFYGDPQVSVWIYVLQETQSGIRNTQKLLYIRYFFKFQVKVFRYNFRFRISKKYNLGVRVKFEIPFGFSDLILGLKRFETIYSGLYDCFETLSTAINRKNCVCSQVAERRLTRRRIQPPSSSLSPLHEACSPSSRSSSPSILSDNRSSRVQSRRRQRRSRRCQRQRQRRIAKSNSTSEL

SEQ ID NO: 6 - DNA, 2355 bp, Raphanus sativum
atgacatctctcttctccaaagcccgagctctcacttctctgggctcctactttaaaacgtaccgtccggtcaccggaaaactccatgtggccaccttgacgcttctcctcttccttctcgcagccgctgttgccgtcacctcttctctatggcttagtaagacgacgaaacaatttgatacaccgacattagtcacaagaaaaccggtacccgagctagaatcaccgaagaaaaccggagtactggtaaatggcacaagtttattgaatcaaaaccggtctggttcttactcagaaacatctctatggcttaacaagacaaaatcatataatcagccgacaataataacaacaaaaccggttcacgtaccagtaccagtaccagagaagaaatcaacgaagaaaaccggaatctcggtagattgcacaagtttcttgaaccaaaaccggtccggttcttgctcgagaacagctcaacccggctataataataaccaaaccgaatcgaaccggtcatgtcctgattacttcaagtggatccacgaggatctaaagccatggagagagacggggataacgagagaaatggtggagagaggacaaacgacagcgcatttcaggttagttatagtaaacggcaaagtgttcgtcgaaaactacaagaagtctatacagactagagacgagttcacactgtgggggattcttcagctgctgagaaagtatccagggaagttgcctgacgtggatctcatgttcgactgtgatgatcggcctgttattagattggacggttacagtaaatctaatcatacagctgaaaatgcaccacctgcgttatttagatacggcggagatagatggacggcggatgtcgtctttccagactggtcattctggggatggcaagagattaacataaagccatggagcaaagtgttgacagaaatggaaaaaggaaagaagaagaagaaatttatggagagagaagcttatgcatattggaaagggaacccttttgttgcatctccttcgagagaagatcttcttacttgcaatgtatcctcacaacatgattggaatgctagaattttcattcaggctcaagagattggaaggggagcaagtgagttcatgcaacgagatctatcaatggaaaacgtgtatgattacatgttccatttgttgaatgaatactcaaagcttcttaagttcaagcctcaagttccccaaaacagtgttgaaatctgcacagaagcaatggtgtgcccttctggagatgctaatgatactaataagagatttttgatgggctctttagtcgatgagcctcacaattcaggcccatgttcgctacctcctccttttgatcccaacggtctcgagaagttttataggaagaaactgaatctcatccggcaagttgagaaatgggagcacgcttactgggaaaaccacagatcaagatctaatataggtctaacattttaccggacccgaagaaccaaactagaacggatccgaaaatacaggttcagatccgagtctatgctaaaatatttattggatcttttttatggggacccacaagtttcggtttggatctacgtcctacaagagacccaatcgggtattcgaaatactcaaaaattattatatattagaaaaaaatacaaaacaacactatatatgcgcttcaagcacagatcaagatctaatataggtctaacattttaccggacccgaagaaccaaactagaacggatccgaaaatacaggttcagatccgagtctatgctaaaatatttattggatcttttttatggggacccacaagtttcggtttggatctacgtcctacaagagacccaatcgggtattcgaaatactcaaaaattattatatattagatatttttttaagtttcaggttaaggtttttaggtataatttcaggtttcggatttctaaaaaatataatttgggtgttcgggtaaaatttgagatacctttcgggttttcggatctgattttgggtttgaagcggtttgaaacgatttatagcggtttatatgattgttttgaaacattgtcaaccgctatcaaccgcaaaaattgcgtttgcagtcaagttgcagagaggaggcttactcgtcgtcgcatccagccaccttcgtcgtcattgtctcctctccacgaggcttgctcgccgtcttcccggtcgtcttctccaagtatcttgagtgacaatcgcagcagcagagttcagagtcgaaggcgccagaggcgaagtcgaaggtgccagaggcagagacaaaggcgcattgctaaatcaaactcaacatccgaactttaa

SEQ ID NO: 7 - protein, 1025 aa, Raphanus sativum
MLTNELDKAYEEEEKYWRQRSRILWLQHGDHNSSYFHAITRSRKAANKFSVLEKQDGTAVFAEEQIAASIEEYYDTLFTSASQGKSQIIEDAISPRISPEMNATLTSIPDDLEIKRAVFAIHRDKAPGPDGFSASFYQGFWDIIGEEVCREVRDFFISGQLHRRFNETHVRLIPKIKTPKTVTDYRPIALCSTHYKVIAKILHYLCTSSAKKHCTMAVKTDMSKAYDRLEWSFLRDVMVRFGFHPTWVHWIMECVSSVSYSYLINGGAHGCVVPSRGIRQGDPLSPYLFILCSEVLSGLCSKAFEQGKLCGIKVARNSPPLNHLLFADDTMFFCKSDPISCKELKNIFEKYEVASGQSINCLKSAITFSAKTPIETRRRVKAELNIVGEGGIGKYLGLPEHFNRKKRDIFASITDRIRQKSHSWTSRYLNGAGKLVLLKSILSAMPTYAMTCFKLPKSLCKQIQTVLTRFWWDDKPDHRKMSWVAWSTLTLPKRAGGLGCREIEKFNDALLAKLAWRILKFPESLLAQTLAGKYCHSTPFLSTPAPKSASHGWRGVIAGREVLRQGLGWVIGNGSDINAWSDPWLSPKTPMCPMGPPTEQNKELKVSDLLNGITKEWDLPAIRLHLPQYEEHILKLVPSEFHMKDELCWLHTRSGEYSTKTGYPYWKTNRGEELTDFNWNLCIWQIRTSPKLKHFLWKIKSKDLPVGANLLHRGIQVEGRCKRCGLIETERHVFLQCPFARRVWDLVPVMFKPDPAIITSPEALLQTSRRIVNLPPLGLGETDLYPWIFWYLWIGRNMLIFENREGSEQELARQVSNLDVEAQCFVDAAWNAGTSGGGFGCIFKDMSNKTFHRSSSNRSIVGSALIAEALAVKAGLKAARSLGLRKLVIRSDSKSLIMAINTKEKIVEAQGVLFDIDHLCTLFNSVSFEFVSHDSPRLNHNNLNADPSRWIHFTQLADPRLYLHHEPPPNSINHHAYRREGQDPPKGQKENEIEKRTLQEKCVLIADQDSVFSLSAMVDISVSFR

SEQ ID NO: 8 - DNA, 3078 bp, Raphanus sativum
atgttgacaaacgagcttgacaaagcctacgaggaggaggagaagtattggcgtcaacgtagtagaatcctctggctgcaacacggagaccataattccagctactttcatgccattactagaagccgcaaggctgccaataaattctctgttcttgagaaacaagatggtactgctgtgtttgcagaagaacagatagcagcctctattgaagagtactatgataccctgttcacatcggcgtctcaagggaaatctcagatcatagaggatgctatctcacccagaatctcccctgaaatgaatgcaacactcacaagtataccagatgatttggagatcaagcgagcagtgttcgctattcatagagacaaagctccgggacccgacggtttttcggccagtttctatcagggattttgggacatcataggagaagaagtctgtcgggaggtcagagatttctttatctcgggtcaacttcatcgtcggtttaacgagactcacgtccggttaataccaaaaatcaaaacgcccaagacagtaacggattacaggcccatagcactctgctctacacactataaggtcatcgcgaagatccttcattacctctgtacctcatcagcaaagaagcattgcaccatggccgtcaaaacggacatgagtaaggcctatgatcgactggagtggagtttcttgagagatgtcatggtccgatttggcttccaccctacatgggtgcattggattatggaatgtgttagctcggtttcgtactcatacctcatcaatgggggcgctcacggttgtgttgtaccgtcgcgtgggatccgacaaggcgacccgctgtctccctatttatttattttgtgctctgaggtcttatcgggactctgctctaaggcgtttgaacaaggaaagctgtgtggcatcaaggtagcgcgcaattcaccacctctaaatcatctcctcttcgccgatgatacgatgttcttttgcaagagtgacccgatatcttgcaaagaactaaagaacatctttgagaaatatgaggttgcttctggccaaagcatcaattgtctgaagtctgctataaccttctctgccaaaacacccattgaaacaagacgcagggtcaaagcggagcttaacattgtgggtgaggggggtataggtaaataccttggcctcccagagcacttcaacagaaagaagagagacatatttgctagcattactgatcggatcaggcaaaagtcgcatagctggacctctaggtacctcaatggcgcagggaagttggtcctcttgaagtctattctctctgctatgcccacctatgcgatgacgtgcttcaagttgcctaagtcactctgcaaacagatacaaactgtgctcactcgcttttggtgggacgataaaccagatcatcgtaaaatgtcttgggttgcttggagtactcttactctacctaagagagctggcggtttgggatgtcgggagattgagaagtttaatgatgctctgttagcaaagttggcctggcgaatactgaagtttccagagtccttgctggctcaaacactggcagggaagtactgtcactccaccccattcctctcaactccagctcctaaatcggcttctcatggttggcgtggagttatagcgggcagagaggtgttacgccaaggcctaggatgggttattggtaacggatcggacatcaacgcctggtctgatccttggctctccccaaagactccaatgtgtccaatgggtccacctacagagcagaacaaagagctgaaagtatcggaccttttgaatggcattacaaaggaatgggatctgcctgcgattagactacacttacctcagtatgaggaacacattttgaaactagttcctagcgagttccacatgaaggatgaactctgctggctccatacacgttctggagagtactcaaccaagacgggctacccatactggaagacaaatcgtggtgaagagctgactgacttcaactggaacctctgtatatggcaaattagaacttccccgaagctgaaacatttcctatggaagatcaaaagtaaagatttgccagttggtgcaaatcttttacacagagggattcaagtggaagggcgttgtaagagatgtggattgatagaaacagagcgtcatgtttttctacaatgcccatttgcccgtcgtgtttgggatctggtgcctgtcatgttcaaaccagacccagcgatcatcacctccccggaagctcttttgcaaacctcgcgacgcatagttaatctgccaccactgggccttggtgaaactgatctctatccttggatcttctggtacttgtggatagggagaaacatgttgatttttgagaaccgagagggatcagagcaagaactggctcgtcaggtttctaacttggatgtggaggctcaatgttttgtagatgcagcgtggaatgctggcaccagtggtggaggatttgggtgcatcttcaaagatatgagcaacaagaccttccatcgctcttcatcaaaccgcagcatcgtcggctctgctctaattgcagaagctcttgcggttaaagctggcttaaaagcggcacggtctctgggtttgcgtaagctggtcattcgatcagattccaagtcccttatcatggccattaacaccaaagagaagattgttgaagcacaaggagttctttttgatattgatcacctttgtactctttttaattctgtttcgtttgagtttgtttctcacgactctccacgactaaaccacaacaacctaaatgctgacccatcccggtggatccacttcacacaacttgctgatccacggctatatctacatcatgaacctccaccaaactccataaatcaccatgcatatcgtcgggaaggccaagatccaccaaaagggcaaaaggaaaatgaaatagaaaagaggacactacaagaaaaatgcgttttaatagcagaccaggatagcgttttttcgctttctgctatggttgacatatccgttagttttagatag

SEQ ID NO: 9 - protein, 360 aa, Raphanus sativum
MPSPLTKKPSVQWFNGKAAFRDWFSSNSSANTAGLCKSSQLKVADFSYNFFVGNIPKCLEHFPRTSFQGNCMQNKDLKHRPSSQCGNAQLVKTHESPSSPPKHQSAEIVAKHHKTSRPKWLLALEIVTGSMVALFCLVALFSAVHRWQNRPSLIIPWKKSSSLKEKFAVYVDSEMLKDVSRFTRQELEVACEDFSNIIGLSADSQVYKGTMKGGPEIAVISLCVKEEDWTGYLELYFQRELVDFECWKTILARSEKNLRNINSEGAVCVLPNAMESRYLDVSGNIYAFGVLLLEIAKEYLETPEAMTSLVDPELKHFNQEELETSFDYFKKPPISWLVRLICSHDVECHQSSDRQHATVA

SEQ ID NO: 10 - DNA, 1083 bp, Raphanus sativum
atgccttcgcctctaacgaagaaaccttcagtccaatggtttaacgggaaagctgccttcagagattggttttcttcaaattcaagtgctaatactgctggtctgtgcaagtcttctcagttgaaagtagctgacttttcatacaacttctttgtgggaaacattccaaagtgtttggagcactttccaaggacgagctttcaagggaactgcatgcaaaacaaggatcttaagcacagaccatcttcccaatgcggtaacgcacagctggtcaaaactcatgaaagtcccagctccccaccaaagcaccagtcagctgaaattgtggctaagcatcataaaacatcaagacctaagtggcttcttgcgcttgagatagtcacaggatcaatggtcgctttgttctgcctggttgcacttttctcagcagttcaccgctggcaaaacaggccttctctcatcattccttggaagaaatcttcaagcctaaaggaaaagttcgcagtctacgttgattctgaaatgctcaaggatgtctcgagattcacaaggcaagagcttgaggtggcgtgtgaagacttcagcaacatcattggtttatctgctgatagtcaggtctataaaggaacaatgaaaggtggacctgagattgctgtgatctctctttgcgtcaaagaagaagattggaccggatacctcgagctctatttccagagagagctggttgattttgaatgctggaagacgattcttgcgagatcagagaagaatttgagaaatattaacagtgaaggtgcggtatgcgtgctcccaaacgcaatggagagtcgatatctggatgtgtctggtaatatatatgcatttggtgttcttttgctggagattgcaaaggagtatcttgaaacaccagaggcaatgacgagtttggtggatccggagctgaagcattttaaccaagaagagcttgaaacgtcttttgactattttaaaaagccgccaatttcatggctggtacgacttatctgttctcacgacgttgagtgccatcaaagctcagaccgccagcacgcaacggttgcatag

SEQ ID NO: 11 - protein, 1145 aa, Raphanus sativum
MATKLLSLTCIRKERFSGRYPPVLRKHLNSRPRGGGDGSPSETAVLKIDEEEAVSDAVFRVTGMTCSACAGSIEKEIKRLPGIHEAVIDALNNRAQIQFYPTSVDVETIRETIEDAGFEASLIENEANERSRQVCRIRINGMTCTSCSSSIESVLQSLYGVQRAHVALAIEEAEVHYDPTLLSYDKLLEEIDNAGFEAILISTGEDVSKIDLKIDGEFTDEAMTMIERSLEALPGVQSVEISHGSDKISVLYKPDVTGPRNFIRVIESTVFGHSGHIKATVFSEGGVGRESQKQEEIKQYYKSFLWSLVFTVPVFLTAMVFMYIPGIKHLLMFKVINMLTVGEIIRWVLATPVQFIIGWRFYVGSYKALRRGSANMDVLIALGTNAAYFYSLYTVLRAATSPDFKGVDFFETSAMLISFIILGKYLEIMAKGKTSQAIAKLMNLAPDTAILLTVDEEGNVTGEEEIDGRLIQKNDVIKIVPGAKVASDGYVIWGQSHVNESMITGEARPVAKRKGDTVIGGTLNENGVLHIKVTRVGSESALAQIVRLVESAQLAKAPVQKLADRISKFFVPLAQLLLKLTNYNIAAGKLHWYPESWIPSSMDSFELALQFGISVMVIACPCALGLATPTAVMVGTGVGASQGVLIKGGQALERAHKVNCIVFDKTGTLTMGKPVVVKTKLLKNMVLREFYELVAATEVNSEHPLAKAIVEYAKKFRDDEENPTWPEARDFVSITGTGVRATVKGREIMVGNKSLMSGYKVTITADAEELLAEAEEMAQTGILVSIDNELTGVLAVSDPVKPSAREAISILKSMNIKSIMVTGDNWGTANSIAREVGIDSVIAEAKPEQKAEKIKELQAAGHVVAMVGDGVNDSPALVAADVGMAIGAGTDIAIEAADIVLMKSNLEDVITAIDLSRKTFSRIRLNYVWALGYNLMGIPIAAGVLFPSTRFRLPPWIAGAAMAASSMLRNGPRFVSLLVSFGCILFEDDALVLRIRRNKAEIISNRNGPSLKATRINSAGMTNSNYTELNELYNKYKDKGLEILAFPCNQFGEEEPGTTDQITEFVCTRFKSEFPIFNKIEVNGENASPLYKFLKKGKWGIFGDEIQWNFAKFLVDKNGQAVERYYPTTSPLTLEHDIKKLLNLS

SEQ ID NO: 12 - DNA, 3438 bp, Raphanus sativum
atggccacgaagctattgtcgctcacatgcatacgcaaagagagattcagcggccgttaccctcctgtgctgcggaaacatctaaacagcaggccacgcggcggcggagatggatcaccgtcggagacggcggtgcttaagatcgacgaggaggaggcggtctccgatgcggttttccgcgtcacggggatgacatgctccgcgtgcgctggatctatcgagaaagagatcaagcgtcttcccgggattcacgaagcggtcatcgacgctctcaacaaccgggctcaaatccagttctaccctacctctgtcgatgtggagacgattcgtgagactattgaagatgctggatttgaagcatcactgatagaaaacgaggcgaatgagaggtccagacaagtatgcaggataagaataaacggtatgacttgtacctcatgttcttcatccattgaaagcgtactgcaatcactttacggtgtacaaagagctcatgttgccttagcaattgaagaagctgaagttcattatgatcccacgctcctgagctacgataaactactggaagagatagataatgctggatttgaagcgattcttataagcacaggcgaagatgtgagcaagattgatttgaagatcgatggcgagtttactgatgaagcaatgacgatgattgaaagatcgcttgaagcacttcctggggttcagagtgttgagatcagccatggaagtgataagatatctgtgttgtacaaacctgatgtgacggggccgaggaacttcattcgtgtgatagagtctactgtctttggtcatagtggtcacatcaaggcaacagtattctccgagggaggggtgggcagagagtctcaaaagcaagaagagatcaagcagtactataagtcgtttctctggagtttggtttttacggtaccagtgtttttgacagccatggtctttatgtatatccctggaattaaacatttgctaatgtttaaggtcatcaatatgctcaccgttggagaaatcataaggtgggttttggctacacctgtacagtttatcatcggctggagattctatgttggctcttacaaggctttacgccgaggatcagctaacatggatgttctgattgctctgggaacaaatgcagcttatttctattcgttatacacagtgttgagagctgcaacatctcctgatttcaagggagtagatttctttgagactagtgccatgctcatttcgtttatcatactaggaaagtatctggagataatggcaaaaggcaaaacatctcaagcgatcgcaaagcttatgaacttggcaccagacactgcgatattgttgactgtggacgaggaagggaatgtgactggtgaagaagagattgatggccgattgatacagaagaacgacgtgatcaagatcgttcctggtgctaaagtagcttccgatggttatgttatatggggacaaagtcatgtgaatgaaagtatgataactggagaggcaaggccagtggcaaagagaaagggtgatactgttataggaggcacactgaacgagaacggtgttctgcatattaaggtgacaagggttggttcagagagtgctcttgcacagattgttcgacttgttgaatccgcccagctagccaaagctccagttcagaagttggctgatcggatatccaagttctttgttcctctggcacaactacttcttaaacttacgaattataatattgcagctggaaaactgcattggtaccctgaatcatggataccttcttcaatggatagctttgagctagctcttcagtttggaatctctgtcatggtcatagcttgtccatgtgctcttgggctggctactccaaccgctgttatggttggaactggggttggtgcatcccaaggtgtgctgataaagggtggtcaagctctagaaagagcacacaaggtaaattgcattgtatttgacaagacaggaactctcacgatggggaaacccgttgttgttaaaaccaaactcctgaaaaacatggtacttcgagaattctatgaacttgtggctgcaactgaggtaaacagcgagcatccattggcaaaggccattgttgaatatgcaaagaaattcagagatgacgaagagaaccctacgtggcctgaagcccgtgattttgtgtctatcactggaaccggagtgagagcgactgttaaaggaagagagattatggtgggaaacaagagcctcatgtctggttacaaagttactattacagccgatgctgaggagttgctagcagaagctgaagagatggcccagacaggaattctcgtgtctatagacaatgagttaactggagttctagctgtttcggatcctgtaaaaccgagtgctcgagaagccatctcaattctaaaatccatgaatatcaaaagcatcatggtaacaggtgacaactggggaactgcaaactccattgctagagaagtcggtatcgactctgttatcgcagaagctaaacccgagcagaaagcagagaaaatcaaggaactacaggctgcgggtcatgttgtggcgatggttggagacggagtcaatgactcacctgctctcgtggcagcggatgtaggaatggccattggtgcaggaaccgacattgcaatagaagcagctgatattgtcctgatgaaaagcaacttggaagatgtgatcacagccattgatctatcgaggaaaacgttctcaaggatccgtctcaactacgtatgggctctcgggtataacctcatgggcataccgatcgctgcgggggtgcttttcccgtctactcggttcaggttgcctccgtggattgcaggtgctgcaatggctgcttcttctatgctgagaaatggtccgagatttgtttctttactcgtgtcctttggatgcattttatttgaagatgatgctttagttttacgcatcaggcgcaataaagctgaaataataagcaaccgcaacggcccatcattaaaagccactcgcattaacagcgctgggatgacgaactctaactacactgaattgaatgagctttacaacaagtacaaagacaaaggtctggagattctagcatttccttgtaaccaatttggtgaagaggaacctggaactactgaccaaattacagagtttgtctgtacccgcttcaaatctgagttccccattttcaacaagattgaagtgaacggagagaatgcttcccctctttataagttcttgaaaaaaggcaaatggggaatcttcggggacgagattcagtggaactttgccaagtttcttgttgacaagaatggtcaagctgttgaacgttactacccaactacttctcctcttacactagagcatgacatcaagaagcttctgaacctctcatga

SEQ ID NO: 13 - protein, 337 aa, Raphanus sativum
MSFPHYYLQRGAFTNLSPSQVASGLHAPPPPGMRPMPNPNVHHPQANNPGPHFSMADHRHSDFGHNIHMGMASSASVQPLQPPQMEQPLVKKKRGRPRKYAPPDGQVSLGLSPVPCSSGGSSKAAKDSSAVTDPNAPKRARGRPPGTGRKQRLANLGEWMNTSAGLAFAPHVISVGAGEDIVSKVMSFSQQRPRALCIMSGTGTVSSVTLRQPATTESSLTYEGRFEILSLGGSYLVNEEGGSKSRTGGLSVSLSGPEGHVIGGGIGMLIAASLVQVVACSFIYGGVNNSNKTIKQENKPKEEHKDSEMETNPQEEEEEEEAQLLKQQQQQQHTCRM

SEQ ID NO: 14 - DNA, 1014 bp, Raphanus sativum
atgtcatttcctcactactacctccaaagaggagccttcaccaatctctccccttcccaggtcgcgagtggtctccacgcgccgccgccgccgggaatgagacctatgccgaaccctaacgttcatcatcctcaagctaacaacccgggtcctcatttctccatggccgaccacagacactctgatttcggacacaacattcacatggggatggcttcctctgcttctgtgcagccgctgcagccgccacagatggagcagccgttggttaagaagaagcgtggacggccgaggaagtacgctcctcctgatggacaagtctctttagggctttctcctgtgccttgttcttctggtggtagtagtaaagcagctaaggactcttctgcagtgactgatccaaatgctcctaaacgagccagaggtcgacctcctggtactggaaggaagcaacgtttagctaatcttggtgagtggatgaacacttcagctggacttgcttttgcacctcatgtcatcagtgttggagcaggagaagatatcgtttcaaaagtcatgtcattctcacagcaaagacctcgagctctttgtataatgtcaggcaccggaacagtttcttcagtcactctacgtcaacccgctacaacagagtcttctttgacatatgagggacgttttgagatactaagtctagggggatcttatttggtgaatgaagaaggtggatccaaaagccgaacaggcggtttgagtgtctccctttctggtcctgaaggtcatgttattggcggtgggattggaatgcttattgcagccagcctcgttcaggttgtggcttgtagttttatatacggaggagttaataacagtaacaagactatcaaacaagaaaataaaccaaaggaagagcacaaggatagcgaaatggagactaatccacaagaagaagaagaagaagaagaagcacagctattgaagcagcagcagcagcagcagcatacgtgcagaatgtga

SEQ ID NO: 15 - protein, 105 aa, Raphanus sativum
MGIRGPNRVSVLSIQISVFRVYQNQPYSDYLKVRFGTGSGFIGFGSGVLNVSGSIGYPFSFGFGTDNTHNPKYHETRSIRYLCRVRIGSDSFLSDRVRFEFSDSN

SEQ ID NO: 16 - DNA, 318 bp, Raphanus sativum
atgggtattcggggtcctaatcgggtttcggttttatccattcagatttcggtttttcgggtttatcaaaaccagccctattcggattatttgaaagttcggttcgggaccggttcgggttttatcgggttcgggtcgggggttttgaatgtttcgggttctatcggatatccatttagtttcgggttcggtacggataatacccataacccgaaataccatgaaacaagatccattcggtatttatgtcgggttcggatcggttcggattcatttttatcggatcgggttcggttcgaattttcggattcgaattaa

SEQ ID NO: 17 - protein, 1494 aa, Raphanus sativum
MGKGRAKAVEKRVLDQKLRGSVNVPSGPVYYPTEDEFKSPLDYIHKIKPEAEAYGICKIVPPKSWKPPFGLDLESVRFPTKTQEIHRLQFRPASCNSKTFQLEYGRFVEERLGKKVKKRVVFEGGDLDLCKVFNAVKRFGGYDKVVKGKKWGEVYQFMSSGEKISKCAKHVLCQLYKEHLHEFEKYHGMMSADPSAKGHKRNRRCSEFSSSKRRKRNNGEKNHKVESEEEEVDQACEQCKSDKHGEVMLLCDSCNKGWHIYCLSPPLKHIPPGNWYCLDCLNTDEDTFGFVPGKCLLLEDFKRIADRAKRKWFGSGPVSRTQIEKKFWEIVEGSGGDVEVMYGNDLDTSVYGSGFPRIGDRRPESVEANVWDEYCHSPWNLNNMPKLKGSMLQAIRHNINGVTVPWLYLGMLFSAFCWHFEDHCFYSVNYHHWGEAKCWYGVPGSAASAFEKVMRKALPDLFDAQPDLLFQLVTMLSPAVLQENKVPVYTVLQEPGNFVITFPKSFHAGFNFGLNCAEAVNFATADWLPYGGYGAELYRLYRKPAVISHEELLCVVAKGNSCDGKGSIYLKKELLRIYSKEKTLREQLWKSGILRSSPMFLPECPDSVGIEEDTTCIICQQFLHLSAIVCSCRPSVFACLEHWKHLCECEPTKLRLVYRYTLAELHGMVQEVEKFGDCKTQETKNSQRPSSGTKRSGASNKKEGMQVCQARPAEDWLRRASKVLQDVFSSDVYATLLKEAEQFLWGGSEMNRVRDVAKSLIKAKIWAEAVGDCLSKVEGKGNNDTEKVHLEFIDELLKVDPVPCFQSGYLKLKDFAEEARKLSEKIDCSLSSSPTIAQMELLHSEVSSSPVSLSKHKILSKKISSAKMLAKRARCYLAASKPPGIELDELFKLKSEILELQVTLTETEGILDLLKKSELARDKCSKVLSGFISLKNVEDLVHEFDGLCSINIRELNILRQYHVDALSWISRFDDTMADVREGKDQRKLISDLSSLLQDGASLGIQVSEIVEGLPLVEVELKKASCREKAQTVYAARSSLDFIEQLLSEAVVLQIEEEKLFVEIAGTLSTARFWEERASSILASETQMSDLKELVHPCLVFLKSFVHQKDDVRRMSVNIGAVLPSLKGIENTISLAETWLQNSEPFLSAVSSTASSPCSLLELPVLKDLVAQSKSLGVQLEEPRILETLLLSCERWQCDNHPLLQETEDLLDTAKTDDGKHSTILPKIMDLITRVDCARTSGLSLGLNLEELPKLQTASLKLGWCYKTILLGSSSPSPEIPEDLGKPSLQKIQQHLEAVCSDNNINFLRLGQTLKILPEEYHLGKRLVELKDTGQEWAKRARKVVTDSGALALEDVFELISEGENLPVIAEEELQALRARSMLHCVCLKPYNSRFMVSCSQCGEWYHTYCVKLHWRPEAYVCFACCPPAESSPKNDPSRSMEPKTPSLDHRRARRVVTGAAVGDLQWKSRKRIKRVAKRCLQVHILPWFFTREPK

SEQ ID NO: 18 - DNA, 4485 bp, Raphanus sativum
atgggaaaaggtagagctaaggcagtagagaaaagggttttagatcagaagctgagaggatcggtcaatgtcccgtctggaccggtttattacccgaccgaagacgaattcaaaagccctctagattacatacacaagatcaagcccgaggcagaggcttacgggatctgcaagattgttccaccgaaaagctggaaaccgcctttcggtttggacttggagtctgtcaggtttccgacaaagacgcaggagattcaccggttgcagttccgtcccgcttcttgcaactccaagacgtttcagctggagtacgggaggtttgtggaggagcgtttggggaagaaggtgaagaagagggtggtttttgaagggggtgatttggatctgtgtaaggtgtttaacgcggtgaagaggtttgggggttatgataaggttgtcaaggggaagaaatggggtgaggtttatcagtttatgagctctggtgagaagatctccaagtgtgctaagcatgttttgtgtcagttgtataaagagcatttgcatgagtttgagaagtatcacgggatgatgagtgcggatccttctgcaaagggtcacaaaaggaatcgacggtgttctgagttctctagctcgaagagaaggaaaagaaataatggcgagaaaaatcataaggtggaaagtgaagaagaagaggttgatcaggcatgtgagcagtgcaaaagtgacaaacatggtgaagtgatgctcttgtgtgatagttgtaataaaggttggcatatatactgtctctcgccgccgttgaagcatatcccgcctgggaactggtattgccttgattgcttaaacactgatgaagacacttttggctttgtgccgggtaaatgtttgctacttgaagatttcaagcggattgctgatcgcgccaaaaggaagtggtttggttcagggccggtgtctaggacgcagattgagaagaagttttgggaaatagtagaagggtcaggtggtgacgttgaagttatgtatggtaatgacttggatacttctgtttacgggagtggttttcctagaataggtgatagaagaccagaatcagttgaggcaaatgtttgggatgaatattgccatagcccttggaatctcaataacatgcctaagttgaaaggatctatgcttcaggccattcggcataacatcaatggtgttacagtgccttggctatatcttggaatgctcttctctgctttttgttggcattttgaggaccattgtttttactctgtgaattatcaccactggggagaagcaaaatgttggtatggtgttccaggcagtgctgctagtgcttttgaaaaggtcatgcgaaaagccctacctgatctctttgatgctcagccagatttgctctttcaactggttactatgttgagtccggctgttttgcaagaaaataaagtccctgtgtacacagtattacaggagcctggaaactttgtgatcacgtttccaaaatcctttcatgctggattcaatttcggtttgaattgtgcagaggccgtcaattttgccactgccgattggctaccttatggtggttatggtgcggagctgtataggctgtaccgtaaacctgcagtcatatctcatgaagagcttctctgtgtggtagctaagggaaacagctgcgatggcaaaggatcaatatatttgaagaaagaactgctcagaatatatagcaaggaaaaaactttgagagagcagctttggaaaagtggtattttgagatcctctcctatgtttctacctgaatgccctgattctgtgggcatcgaagaggatacaacatgcatcatctgccagcagtttctccatctttctgctatcgtctgcagctgcaggccatctgtttttgcatgcttggagcactggaagcacctttgtgaatgtgaacctacaaaactgcgcctggtatatcggtatacccttgccgagttgcatggaatggtacaagaagttgaaaagtttggtgactgcaaaactcaagaaaccaaaaattcacaacggccgagttcaggcaccaaacggtcaggtgcttctaacaaaaaggaggggatgcaagtttgccaggcacgaccagctgaagattggcttcgtcgagcatcaaaggttctccaggatgtcttttccagtgatgtatatgccactcttttaaaggaagcagaacagtttctttggggtggatcagaaatgaaccgcgtacgggatgttgcaaaaagtttgatcaaagcaaagatatgggctgaagctgttggcgactgtctttcaaaagtcgaaggcaaaggcaacaatgatacagagaaagttcacttggagttcatcgatgagttgctgaaagttgaccccgttccttgctttcagtctggttatcttaaattaaaggactttgctgaagaggctaggaagttgtctgagaaaatcgattgttctctgtcaagtagcccaacgatcgcccagatggagctattgcattccgaagtttccagttcaccagtctccctaagtaaacacaagatcttgtcaaagaaaatatcttccgcgaagatgttagctaaaagggcgagatgctatcttgccgcttcaaaacctcctggaattgagttggatgaacttttcaagctaaagtcagagatattggagcttcaggtgacgcttacagaaacagaagggatcctggatttgctaaagaaatcagaactagcccgtgataaatgtagcaaagttttgagtggttttatatctctcaagaatgtagaagatttggttcatgaattcgatggcctttgtagcattaacattcgtgagctgaatatcctgaggcagtaccatgttgatgctttgtcttggatttcacgctttgatgatacaatggctgatgttcgtgaaggcaaggaccaacgaaagctaatcagtgacctgagttcccttctccaggatggagcatccttaggcattcaagtatctgaaatagttgaagggctccctcttgttgaggttgaattgaagaaggcatcttgtcgtgaaaaagcacaaacggtttatgctgcaagatcgtctctggatttcattgagcagctgctctcggaagctgttgtactacaaatcgaagaggagaagctgtttgttgagatcgccggaactttgtctacagcgaggttttgggaggaaagagcaagcagtattcttgccagtgaaactcagatgtccgaccttaaagaactcgtacacccatgcttagtatttctcaagtcttttgttcatcaaaaagatgatgttcgtaggatgtctgtcaacattggtgccgttttaccctctctgaaaggcatagagaacaccatttcgttggctgaaacttggcttcagaattctgagccctttttatctgccgtttcctctactgcctcatctccgtgttctctgcttgaacttcctgtgttaaaggacctggttgctcagtctaaatcgcttggtgttcaacttgaagagccaaggattcttgaaacattactgcttagttgcgagaggtggcagtgtgataatcacccgctcttgcaagaaactgaagatttgttggacactgcgaaaacagatgatggcaagcatagcacgattcttccgaagattatggacttgataaccagagtggactgcgccagaacatctggtctgtcccttggtcttaatttggaagaacttcccaaacttcaaacggcaagtttaaaactaggatggtgttataagaccatcttgttaggctctagttcaccttcccctgagataccagaagatctaggaaagccctcgttacagaaaattcagcagcacttagaagcggtatgttctgataataatatcaacttcctgcgcttaggacaaacactgaaaatattacctgaagagtatcacttaggcaagagacttgtggagctaaaagacactggacaagagtgggcaaaacgagctagaaaagtggtgacagactcgggtgctcttgccttggaagatgtattcgagcttatctctgagggtgaaaatttgcccgtcattgcagaggaagaacttcaggcattacgagctcgaagtatgttgcactgcgtttgcctgaagccatacaactcaagattcatggtttcttgtagtcaatgtggcgaatggtatcacacctattgtgttaaacttcactggcggcctgaggcttatgtctgcttcgcttgctgtcctccggcagaatcctctccaaaaaacgatccctccagatcaatggagccaaagacaccgtcacttgaccatagacgggcaaggagggtagtgaccggtgcagcagttggtgatttgcagtggaaaagccgtaaacgcatcaaaagggtagctaaacggtgtcttcaggttcatatccttccctggtttttcactcgagaaccaaaataa

SEQ ID NO: 19 - protein, 465 aa, Raphanus sativum
MFQYVSCIVQCGYEPQESNRGLTSSGGDDRIGGEGNDVPQFREFSIETLRNATSGFSTENIVSEHGEKAPNVVYKGKLDNQRRIAVKRFNRKAWPDSRQFLEEAKAVGQLRNYRMANLLGCCYEGEERLLVAEFMPNETLAKHLFHWESQPMKWAMRLRVALHIAQALEYCTGKGRALYHDLNAYRVLFDDDSNPRLSCFGLMKNSRDGRVTPESVMYSYGTLLLDLLSGKHIPPSHALDLIRDRNIQMLIDSCLEGQFSSDDGTELVRLASRCLQYEPRERPNPKSLVTAMIPLQKDLETPSHQLMGIPSSASTTPLSPLGEACLRTDLTAIHEIVEKLGYKDDEGAATEMWTNQMQDSLNFKKKGDVAFRHKDFANAAECYSQFIEGGTMVSPTVYARRSLCHLMNEMPQEALNDAMQAQVISPAWHIASYLQAVALTALGQENEAHAALKDGSMLESKRNAL

SEQ ID NO: 20 - DNA, 1398 bp, Raphanus sativum
atgtttcaatatgtttcttgcattgttcaatgtggctatgagcctcaagaatccaatcgtggactcaccagctctggtggtgatgataggataggtggtgaagggaacgatgtgcctcagtttcgtgaattctctatagagacgctaaggaacgctacgtcagggttttctacagagaatatagtatcagagcatggtgagaaagctcccaatgttgtctacaaagggaagttggataatcagagacgtatcgctgtcaagaggtttaacaggaaagcttggcctgattctcgtcagttcctggaggaagctaaagctgttggtcagttaaggaactataggatggctaatctgcttggatgttgttatgaaggtgaagagagacttcttgttgctgagtttatgcctaatgaaactttggctaagcatcttttccactgggagtcacaaccgatgaagtgggcaatgagactaagagtagctttacatattgctcaagctttggagtactgtacaggcaaagggcgtgcactctaccatgaccttaatgcttatagagttctctttgatgatgactcgaatccaaggctttcttgctttggtctgatgaaaaatagtagggatggtcgcgtgacaccagaaagtgtgatgtacagttatggaactctgttgcttgatcttctcagtggaaaacacattcctccaagccatgcgctggacctcataagggacaggaacattcaaatgttgatagactcatgtttggagggtcaattttcaagtgatgacgggactgaactggtacggttagcttctagatgcttacagtatgagcctcgagaacggcctaacccaaaatctctagtcactgcaatgatccctcttcagaaggatcttgagactccttcacatcaactaatgggcataccaagcagtgcctcaacaacgcctctttcaccactcggagaagcatgcctaagaactgacctaactgccatacatgagattgttgaaaaacttggttataaagatgatgagggagcagccacagagatgtggaccaaccagatgcaggactcgctgaacttcaagaaaaagggtgatgttgctttcaggcataaagactttgcaaatgctgctgaatgttattctcagtttatagagggtgggacaatggtttcaccaactgtttatgcaaggagaagtctgtgtcacctgatgaatgagatgcctcaagaggcgttgaatgatgcaatgcaagcccaagtgatatctcccgcttggcatatcgcatcttatcttcaagctgtagctctcacagctctaggacaagagaacgaagcacacgctgctcttaaagacggatcaatgctcgaaagcaaaagaaacgctctatga

SEQ ID NO: 21 - protein, 614 aa, Raphanus sativum
MASQCSENVIPTLRDFFNSQKPGEEDEFMVHQVLNSSSKNIPPRPTKLGNKAKERHGLFNQGRIRSRRNISDAEKFSVEQYSSSGFFGVRFNTNGRQQQQQRSAKPLGSDRNMEPRLQKSFSARMQLPFMLSSKPSNQSTNNSSWFSRIKKMSNPFSNRNSLIPKSGEIKVSGVGETLSRNKSSSPVHLHAHLSIQHELGMPVFTFSLDHPDDVYTARTWMDVNDSRFVYSFRYIGGRSNKNLGEQRSNVSGIDSSLIGQMQVSTQVSLEVEEEPYEDPVESAVSEFVLFDIARARRSGLKTEQLSRQNSVSDGLKHLQRQNSFSRGLTRSFSKHSENSASSSSDPWPATDLHPGLEIAAVVIKDSYSSSNNESFEYMKNSKLSRREMKVIVPSGNHGLPDAENSCPTPILQRWRSGSQLYKHSQYVWLSCTEQKYQEEKEATLCLGAVRLESLLTWQLRQPDECSSFSKPIQHNFAKLMRFIWNVPGGDGDNNLNGTCWLPSLPYMTQNVQNAKAPSYSISSTKTPPPLQLLLPPPLNAIRHDQLAQPLLISPLIVINAFNGQECKITDRFKGFKEEETVKFYIYWRCLNRFLIRVATCCATHTVPATVQQNP

SEQ ID NO: 22 - DNA, 1845 bp, Raphanus sativum
atggcatcgcagtgttctgaaaacgttattcctactctacgtgatttcttcaactcccaaaagccaggggaagaggatgagtttatggttcatcaggtcctcaactcctcttccaagaacattccaccgagacctacaaaactaggaaacaaggcaaaagagagacacggtctcttcaatcagggaagaataagaagcagaagaaacatatcagatgctgaaaagttctctgtggagcaatactcttctagtggtttctttggggtacggttcaacacaaacggaagacaacaacagcaacaacgatcagctaagcctttagggtcagatagaaacatggaaccgagattgcagaagtcattctccgctagaatgcaactcccctttatgctatcttcaaagccaagcaaccagtctacgaataattcaagctggtttagccgtatcaagaaaatgtctaatccattttcaaatcgaaactctctgataccaaagtcaggagaaatcaaggtcagtggagtaggagaaacactctcaagaaacaagtcttcttcacctgttcatctacatgcccatctcagtatccaacatgaacttgggatgcctgttttcaccttctctctagaccacccggatgatgtgtatacggccaggacgtggatggatgttaacgactctcggttcgtctattcgtttcgttacattggtggtagaagcaacaagaacctcggagaacagaggtcgaacgtttcaggtatagactcttcacttataggacagatgcaagtttcaactcaagtctccttagaggtagaagaagaaccatacgaagatcctgttgaatcagccgtgtcagagttcgttctttttgacatcgcacgagcacggagaagtggactcaagactgaacaactgtcaagacagaacagtgtatctgatggcttaaagcatctgcaaaggcagaacagtttcagcagagggttgactcgtagtttctcaaaacattcagagaacagtgcatcatcatcatctgatccttggccagccacggatttacatccaggtctagagattgcagcagtcgttattaaagactcttattcttctagcaataatgagagttttgagtacatgaagaacagtaaactctctagacgagagatgaaggttatagttccatcaggaaaccacggtttgcctgatgctgaaaactcatgtcctacaccgatactgcagagatggagatcaggctctcagctttacaagcattctcagtatgtgtggctgagctgcacagaacagaagtatcaagaggagaaagaagcgactctttgtctaggtgcagttcgcttagagagcttattgacatggcaactccgccaacctgatgagtgtagttcgttctccaagccgatccaacacaacttcgccaagctcatgcgtttcatctggaacgtaccaggaggagatggagacaacaatctcaatggtacttgttggttgccctcgttgccttatatgacccaaaatgtccaaaatgcaaaagcaccgtcctactcgatttcctcaaccaagacgcctcccccgctacaactgctcctgccgccaccactgaacgcaataagacatgaccaacttgcacagcctctcctaatcagcccattaattgttataaacgcttttaatggtcaggaatgtaaaatcacagaccggtttaaagggtttaaggaagaagagaccgtgaaattttacatttactggagatgcttaaatcggttcttgatcagagtggctacgtgctgcgcaacccacacggtgccagccacggtgcagcagaatccatga

SEQ ID NO: 23 - protein, 486 aa, Raphanus sativum
MEIEELELTPLRQPSPEMKQSWVLKPTLSKKKKKLSVACISSNKRLLVWLGGVLAVSSIVVITLFKTLPHHQSIPPPQDNSTIALPMALKFFNAQISGKLPEGNNVSWRGNSCLNDGNFPGSLYPHLAGGYYDAGGSIKTSFTMSFSMTMLSWSVIEYGSKYEACGEVDHVKGLIKWGTDYFLRTFSSSSDTIYEMVYQIGMNQGSQVTSDLYCWMRPEDIDYQSAKAVYLYAEAMSAKRKSADHWDDLIWGGAWLYYATGDNSYLAKVTSHDLANRAGAFSHGPRYGVFGWDNKLAGTQLLFTRLRLFLSPPFPYEEMLRVFHEQTSIVMCSYLPYYTKFNRTKGGLILLSEPEPLQYAANAAFLATLYSDYQGASDAPGWYCGPTFFKTEILRDFSTSQGSLDPEEQESDMRRRFEVEGEHERESKHDRRGNGRWTRQEGWLPRRLLKESLLNNIVSTQICSFTEGDKFIISSQYCNTQVVGKT

SEQ ID NO: 24 - DNA, 1461 bp, Raphanus sativum
atggagatcgaggagctcgagcttacacctctgagacagccttctccggaaatgaagcagagttgggttctcaaaccaacactctccaagaaaaagaagaaactttctgttgcttgcatctcaagcaacaaaaggttacttgtatggcttggaggagtcttggctgtgtcgtctatcgtcgtgataacactgttcaagacactcccccaccaccagagcattccaccaccgcaagacaatagcaccatcgcacttcctatggcattgaaatttttcaatgcccaaatctccggaaaactgccagaggggaataacgtgtcttggaggggaaattcttgcttgaacgatgggaattttcccgggagtctttacccacatctggcgggagggtactacgatgctggaggttcgatcaagacaagcttcaccatgtctttctcaatgacaatgttgagctggagtgtcattgaatatgggtcgaaatatgaggcttgtggagaagtggaccacgtcaaagggctcattaaatggggaaccgactacttcctccgcacttttagcagcagttctgatacgatctatgaaatggtgtatcagatagggatgaatcaaggaagccaagtgactagtgacctatactgctggatgcgaccagaagacattgattaccaaagtgccaaagccgtttacctttacgccgaggctatgagcgccaagcggaaaagcgcagatcactgggatgacctcatatgggggggagcgtggctctactatgccacgggtgataactcgtatcttgctaaggtaaccagtcacgatctagccaaccgtgccggtgccttttcccatggccctcgttatggtgtctttggttgggacaacaagcttgctgggacacagttgcttttcactcggttgaggctgttcttgagccctcccttcccgtatgaagagatgctcagggtctttcatgagcaaaccagcatagtaatgtgctcctacttgccgtattacactaagtttaacagaacaaaaggtggtttgatcctgctgagcgaaccagagcctctccagtatgctgcgaatgcagctttcctggccactctgtacagtgactaccaaggcgcttctgacgctcctggatggtactgtgggccaactttcttcaaaactgagatcctacgtgacttttcgacatctcaagggagcctcgatcccgaagaacaagaaagtgacatgcgaaggaggtttgaagtggaaggagagcacgagcgagaatccaaacacgatcgaaggggcaatggtcgctggaccagacaagaaggatggcttccacgacgtttactcaaggaatcacttctcaacaatattgtttccactcaaatctgttccttcactgaaggagacaaatttataatctcttctcaatattgtaacacacaagtggtaggaaagacttga

SEQ ID NO: 25 - protein, 58 aa, Raphanus sativum
MIYRFWPKARFSGFGGKSRFPVLAGNHDFPVLAEKRDFSVFAEKKFSVLAENMISLFW

SEQ ID NO: 26 - DNA, 177 bp, Raphanus sativum
atgatttatcggttttggccgaaagcacgattttccggttttggcgggaaatcacgatttccggttttggcgggaaatcacgattttccggttttagcggaaaaacgtgatttctcggttttcgcggaaaaaaaattctcggttttagcggaaaacatgatttctctgttttggtga

SEQ ID NO: 27 - protein, 401 aa, Raphanus sativum
MEWPALASELDEIAALSKEFMSLSICAIPRTQNARADGLAKGGRTRKLIPFVSDSAPTWLAPEASLTAVELSPHLAIDLFSSSYRAFVIIDPVLGPVWIKVKPTSNNNHPVLGHQPGQVFIPIWMVCLTPKVYEKPIYIVMFLPSASSFEKKLHRLKKLMQMCRNNILKRAPNPPSTTLISYLIKLEITNTRINFTDNAFKFQRERLIAPMSHLLRRKTVMAPEKSSQPPDMETKLDLEPESQSKRERTTEINDSIERHRRLQIFSTKKTITIMVGWFKELCLENGNPEAHYIVQYFVHKEKQTGLFHLRQSATRNNGNNMHLYVLLMLAEGHYQTGKKYLDKLQWKKKRSTSDHCCERIKNSLSAIPVPMEQRYYVNMVNLKPHTNCDPNNMAKVCKQCY

SEQ ID NO: 28 - DNA, 1206 bp, Raphanus sativum
atggaatggccagcattggcctctgagttggatgaaattgcagcactgtctaaagagtttatgagcctctctatatgcgcaatcccgagaactcagaatgcccgagcggacggcttggcaaaagggggacgtacacgcaagctcatcccgttcgttagtgactccgcacctacatggctagcccctgaagctagtctaacggctgtagaactatcccctcatcttgcgatagacctattttcttcttcttatcgggcctttgtaataattgacccggttcttggaccggtatggattaaggtgaaacctacctccaataataatcatccagtcctcggtcatcagccaggtcaggtgtttattccgatttggatggtatgtttgacgccgaaggtttatgaaaaacccatttatatagtgatgtttttgccttcggcatcgtcttttgagaagaaattgcacagattgaagaagttaatgcagatgtgcagaaacaacatccttaagagagctccaaatcctccatctacgacccttatcagttacttgatcaaacttgagatcacaaatacacgcatcaactttaccgacaacgctttcaagttccaaagagagagattgattgctcccatgtctcatctgttgagaagaaaaactgtcatggctcccgagaaatcctctcagccgccggacatggagacaaagttggatctagagccagagagtcaaagcaaacgtgaaaggacaaccgagatcaatgatagtatcgagagacaccggagactgcagattttttcaactaaaaaaacaataacaatcatggtcgggtggttcaaagaattgtgtttagagaacggcaatcctgaggcgcactatattgttcaatacttcgtccacaaagaaaaacagacaggcctctttcatctacgccaatcagccactaggaacaatggaaataatatgcatctttacgttttgttaatgcttgctgaaggtcactatcaaaccggtaaaaaatatttggataaactccaatggaaaaagaaacgatcaacctccgatcattgctgtgaaagaatcaagaactcactaagtgcaatacctgttcctatggagcagcggtactatgtaaatatggtcaaccttaagccacatacaaattgcgatcccaataacatggctaaagtatgcaagcaatgttactaa

SEQ ID NO: 29 - protein, 598 aa, Raphanus sativum
MRIGVSEPEQCGCDTCVQHRTLCTQETEPSKEVTGSSVPVSSEPVQRLGSTSDQCSGTHTTPLAPPEPAAQSVDASSTSSSIFSSVSSQPARALCPTGSLPVPLFGCSWPRPCSCTGCSLLGPSIRRSSPFFTASSGSSISSSRQANVTNSFGSAASEPSVSGPMKAPIFTSGSSTASTSSTLPSLVTPSDITRGSVQAPVQANTSKTASDFHPPNVANTGVCAASRTSTNNPFPGFSVDYLPRCPSNLSRPNAPTTTPVPGPSSVLAGGETEQGSRYPRYAPTPDVDGKQIISISASNSHGHKSHEELRWEDYKNGDKAGVGSFPPPDHTPSVFTPPSIPDRPRMRTIDLTNRDTSGFPIGYNTPAAFQSPHEPVGVSSPASGCTACGAASSSSPSSHLGLNSTTNPPSSATSLPGLFFSTYGSFPLLFATPNLAAYGTTPAVQAYPMMFGIPNLAAQGTATPSVQAYPMIFGIPNLAAQGTTATPAFQAYPMIFGIPNVAAQGTTTTTPAAQAYPMMFGIPNLAAQGTTTPAAQPYPTMFGTPSLAAQGTTTAPAVQPYPTMYGTPNFVAQGMTPAAQAYPVNGSSLLPFAAMSLQ

SEQ ID NO: 30 - DNA, 1797 bp, Raphanus sativum
atgaggattggtgtttctgagccagagcaatgcggttgcgacacgtgtgtccagcatcgcactttatgcactcaagaaaccgaacctagcaaagaagtgactggctcatcggttcctgttagttcagaaccagttcaacgtctcggttccacctcagatcagtgttccggaacacatacgactccactcgctcctcctgaaccagcagcgcagtctgttgatgcatcctccacatcatcctccatattcagttctgttagttcccaaccagcgcgagctctttgtcccaccggttcactgccagttcctttatttggttgttcatggccacgtccttgtagctgtactggttgttcactgctaggtccttctattcgtcgttcatctcccttctttactgcttcttccggatcatcaatctcctcgtcaaggcaagccaacgttacaaacagtttcggttccgctgcatccgaaccatctgtatctgggccaatgaaagctcctatttttacttctggctcttcaaccgcttccacatcctcaactctaccttcattagttactccctcggacattacaagaggatcagtgcaagcgcctgtccaagctaacacttccaagactgcttctgattttcatccacctaacgttgccaacactggagtttgcgctgcttcaaggactagcacgaacaatccatttccaggatttagtgttgattacttgcccagatgtccctctaacctttctcgaccaaacgcaccaactactacaccagttcctggccctagttcagttttggctggtggtgaaactgaacaaggtagtaggtatcctcgttatgcgcctacaccagatgttgacggcaagcagattatttccatatctgcttccaactcacatggacataaaagtcatgaagagttgaggtgggaagattacaaaaatggagacaaagctggggttgggtcgtttcctcctcctgatcatacaccgtcggtgtttactcctccaagcatacctgatcgtcctcggatgagaactattgatctaacgaaccgagacacgagtggttttcctattggctacaacacccccgctgctttccagagcccccatgaacccgttggtgtttcttccccagcatcaggatgcacagcgtgtggagccgcgagtagctcctctccttcgagtcacttgggcttgaacagtaccacaaatcctccatcatctgcgacatctcttcccgggctgttcttttccacctatggttcttttcctttgctgtttgcaacaccaaatcttgcagcttatggtacaactccagcagtccaagcctatcctatgatgtttggaataccaaatcttgctgctcaaggtacagcaactccatcagttcaagcgtatcctatgatatttggaataccaaatcttgctgctcaaggtacaacagcaactccagcttttcaagcgtatcctatgatatttggaataccaaatgttgctgctcaaggtacaacaacaacaactccagcggctcaagcgtatcctatgatgtttggaataccaaatcttgctgctcaaggtacaacaactccagcggctcagccctatcctacgatgtttggaacaccaagtcttgctgctcaaggtacaacaacagctccagcagttcagccctatcctacgatgtatggtacaccaaattttgtagctcaaggtatgactccagcagctcaggcctatcccgttaatggttcaagtcttctcccatttgccgccatgagtctgcagtaa

SEQ ID NO: 31 - protein, 707 aa, Raphanus sativum
MRIDVSEPELCGCDTCVQHRTFITQETEPSKEVIGSSVPVSSEPVQPLGSTSDESSGTETTPLAPPPVTTPVNNPEPAAQSVGSTIPPAVTPVSSEQPAQALGSTSDQSSGTETTPLAPPITTSVKSVDSTIFFKFPPVQAQALAPTASGSTQAPAFGFGAFAARVPSATSGCSAFSFAPPVTSAPVQALGTTTTTTTTTSAAAPASPFHSSSPTTFQFPPAFTSLAASTFPSVASSTSSPLDAPPSPFRWGSLQANTSPPFSFLPAQGSDKTGSAFTPPFGYPGGFARPDVGVSHPGFGPSNHFGPNAPTTTPVPVRSPFLAGGGTEQGSRYPRYSPTPDVDGRLIMSISASNSHGHKSHEELRWEDYKNGDKGGFGWFPPVHTSPFSSPTVSPSLFAPPSIPNRPQMRTIDLTNRDMCGFPIGYNTPAAFQRPPEPAGVSSPASGCTACGATSRSSPSSHLGLNNTTNPPSAATSLPGMFFSTYGSCPLLFGSPNLATYGTTAIPAVQAYAIMFGAPNFTSQGTTATPAFQAFPIMFGTPNLAAQGTTRAPAVQAYPTMFGTPNIGVQGSTPAAQTYPLMFGTPNLAAQGTTNIGARGTTPAAQAYPLMFGTPNLAAQGTTTPAVQSYPTMFGTPNLAGQSTTTTRAGQPYPTTFAVPQAATAPAVQPYAMMFGTPSLGAQDITPGGQAYPAHGLTLPFAAMSLQ

SEQ ID NO: 32 - DNA, 2124 bp, Raphanus sativum
  CDS (1)..(2121)
atgaggattgatgtttctgagccagagctatgcggttgcgacacttgtgtccagcatcggactttcattactcaagaaaccgagccgagcaaagaagtgattggctcatcggttcctgttagttccgaaccagttcaacctcttggttccacctcagatgagagttcaggaacagagacgactccactcgctcctcctccagtcaccacaccggttaataatcctgaaccagcagcgcagtctgttggctcaaccatcccacctgctgttacaccagttagttccgaacaaccagcacaagctcttggttccacctcggatcaaagttccggtacagagaccactccactcgctcctcctatcaccacgtcggttaagtctgttgactcgaccatcttcttcaagttcccaccggtacaagcacaagctcttgcccctactgcttccggttcaacgcaagcccctgcttttggttttggtgcattcgctgctcgcgtaccatctgccacctccggttgttcagcatttagtttcgcccctcctgttacatcggcaccagtgcaagctctaggcacaaccactactactactactactacatccgcggccgctcctgcatctccatttcacagttcctcaccaaccacattccaattccctcctgcttttacatcccttgctgcttctacttttccttctgttgcatcatcaacttcatctccacttgatgctcctccctcaccatttagatggggatcactgcaagctaacacttccccaccctttagcttcttgccagcgcaaggttctgacaagactggttctgcttttactccaccgtttggctaccctggtggttttgccagacctgatgttggtgtctctcatccagggtttggtccctctaaccattttggaccaaacgcaccaactactacacctgttcctgttcgcagtccatttttggctggtggtggaactgaacaaggtagtaggtatcctcgttattcacctacaccagatgttgacggcaggctgataatgtccatatctgcttccaactcacatggacataaaagtcatgaagaattgaggtgggaagattacaaaaatggagacaaaggtgggtttgggtggtttcctcctgttcatacatctcccttttcctcaccaacggtatcaccgtcgctatttgctcctccaagcatacctaatcgtcctcagatgagaactattgatctaacgaaccgagacatgtgtggttttcctattggctacaacacccccgctgctttccagagaccccctgaacccgctggtgtttcttccccagcatctggatgcacagcgtgtggagccacgagtaggtcctctccttctagtcacttgggcttgaacaataccacaaatcctccatcagctgcgacatctcttcccgggatgttcttttctacctatggttcttgtcctttgctgtttggctcaccaaatcttgcaacttatggtacaacagcaattccagcagtccaagcctatgctattatgtttggggctccaaattttacttctcaaggtacaacggcaactccagcttttcaagcctttcctattatgtttgggactccaaatcttgctgctcaaggtactacaagagctccagctgttcaagcctatcctacgatgtttggcacgccaaatattggagttcaaggttcaactccagcagctcaaacctatcctttgatgtttggcaccccaaatcttgctgctcaaggtacaacaaatattggagctcgaggtacaactccagcagctcaagcctatccgttgatgtttggcaccccaaatcttgctgctcaaggtacaacaactccagcagttcagtcctatcctacgatgtttggaacaccaaatctagctggtcaaagtacaacaacaactcgagcaggtcagccatatcctacgacgtttgctgttcctcaagctgcgacagctccagcagttcagccgtatgctatgatgtttggtacaccaagtctcggagctcaagatatcactccaggaggtcaagcctatcccgctcatggtttaactctcccattcgccgccatgagtctgcagtaa

SEQ ID NO: 33 - protein, 273 aa, Raphanus sativum
MARIITTLSTPLFFFFLFSLLSHQTISQPEHLTTFCNPSDNFTQTSSYEANRDLLLSSLRVSSSLGTYSNATVGRSPNTVHGMFLCRGDTTAASCSDCVQTATIEIATNCTLNKEAVIYYEECMVRYSNVSFFSVLEVRPSIVLYSLRSAPNSNTLNETLADKFNQLILNVSSSSLVPYFLEDQELVTQAEGSYKFESMVQCSPGLDRFNCTVCLRFALLRVSTCCGSPSSALIFTPKCLLRKPNIWENCYDDGSFGVCTCEFVNTFDDFGLK

SEQ ID NO: 34 - DNA, 822 bp, Raphanus sativum
atggcaagaatcataactacactctctacacctctgtttttcttcttcctcttctccctgctctctcaccaaaccatttctcaacccgaacacttgactactttctgcaacccttccgacaacttcacacaaaccagttcatacgaagcaaaccgagaccttctactctcctctctccgcgtcagttcctccctcggaacctattcaaacgccacagtcggtcgtagtcccaacacagtccacggcatgttcctctgcagaggagacaccaccgcagcgtcttgctcagactgcgtccagaccgctacaatcgagatcgctacaaactgtactcttaacaaagaagcggtcatatactacgaagagtgcatggttcggtactctaatgtttccttcttctctgttcttgaggtcagaccgagcatcgtcctttactctcttcgctctgctccaaactcgaatacgctcaatgaaacgttagctgataaattcaaccaactgattctcaacgtgtcttcgtcctctttggttccgtattttctggaagatcaagaacttgtgactcaagcagagggttcttataagtttgagtcaatggttcagtgtagtcctggtcttgaccggttcaactgtaccgtttgtctcagatttgcgctcttaagagtttcaacttgttgcggttcaccaagttctgctctgatctttactcctaaatgtcttttgaggaaaccaaatatttgggagaattgctatgacgatggcagttttggtgtttgcacttgtgaatttgtgaacacatttgatgattttggattgaaataa

SEQ ID NO: 35 - protein, 72 aa, Raphanus sativum
MEIHKSRFGSTSYKRPNQISKKYNLGVRVKFEIPFEFSDLILCYIPYPESFDIQLIALYYHFGFCDWLTRFC

SEQ ID NO: 36 - DNA, 219 bp, Raphanus sativum
atggagatccacaagtctcggtttggatctacgtcctacaagagacccaatcagatttccaaaaaatataatttgggtgttcgggtaaaatttgagatacctttcgagttttcggatctgattttgtgttacataccttatccggaatcatttgatatacaacttatcgctttgtactaccattttggattttgtgactggctgacccgtttctgttag

SEQ ID NO: 37 - protein, 1062 aa, Raphanus sativum
MSGVYAPSDVTSFLSFDGSESRSSLDGSKKGHQNLVEWLNQTLPYLNLPSEASEDEGGSFEPAYVRVERFLTAMDEMALPRFEVSDIEQKVKMQGDMLPVFQSLKALKASFSDGGNDKNSLGARRRWSLPEDHSDSRGDDRNFIDGFQSKEGFEIDTSDAKISELLKSDSLRNAPTRTLFDMLDKLLDESVKKMNGHVSHAMASLLSALVQVIEQRISNQADNLKNQNILFRVREDKYRSRIKVLETLAAGATQENEIVSNCMERTKLEKSRIEEREKSEEKDVVRLKKEKERSDAEIRKLKQELKVVKEAHANQCLELEAKAQNSTVELESKLKDAELQVAESTRKVKELEKLYLSKSQKWENRESTYQSFIDNQFGALQALNATSVSIKQEVLRTQKKYFEDLNYYGLKLKGVADAAKNYHVVLEENRRLYNEVQELKGNIRVYCRIRPFLPGQNSGQTSIEYIGENGELVVANPFKQGKDTHRLFKFNKVFGQAATQEEVFLDTRPLIRSILDGYNVCIFAYGQTGSGKTYTMSGPSITSKEHWGVNYRALNDLFHLTQLRQNTVVYEVGVQMVEIYNEQVRDILSDENFLNLRTLGVWNTALPNGLAVPDASMHSVRSTEDVLELMNIGLMNRTVGATALNERSSRSHWIIEMTLLPIVYSVLSVHVRGVDVETDSVLRGSLHLVDLAGRGQAKTLMFVQVNPDGDSYAETVSTLKFAERVSGVELGAAKSNKEGRDVRHLMEQVSSLKDVIAKKDEELQNVQKQKSNSTTVPKRGLSNLRLLGPSSPRRHSIGPSPNARRGKAPGSFGRAASDFDNCSEYSSKHSDSGSPRSSDELKHRKDLHQLSKFAGGSKEIDIEDDIELIGLGDADSEDRLSDISDSCLSMGTETDGSICSAVELTLFPETVKPLEITEEPEPHLVPEKLEKSAKMVKTVPKDKTRTWSYQLFASFYGPDVPKTFISHLRRQLNSKGILMFDDQGTERGQAIRGSVISIVVLSKNYASSSWCLKNLLEILKCKEQIVTTVFYGVDPSDVRKQTGDFGKAFKETCRGSKDGDKL

SEQ ID NO: 38 - DNA, 3189 bp, Raphanus sativum
atgagtggcgtctatgctccctccgatgtaactagttttctcagcttcgacgggtctgaaagtcgttcaagcttggatggtagtaagaaaggtcatcagaatttggtggaatggttaaatcagacacttccttatttgaatttaccatcggaagcttcggaggacgaaggaggcagctttgagcctgcttatgttagagttgagcggtttctgactgctatggatgaaatggccctgcccagattcgaggtttcagacatagaacagaaagtaaaaatgcagggggatatgctgccagtttttcagtcccttaaggcccttaaagcaagtttttccgatggtggtaatgataaaaactcactaggtgcgaggaggagatggagcttgccagaagaccattcggattccagaggagatgaccgcaactttattgatggattccagtcgaaggaaggatttgagattgatacatcagatgctaaaatttcagaattactgaaatctgacagtttacgaaatgctcctactcggacactatttgacatgctggataaacttctagatgagagcgtgaagaagatgaatggacatgtgtctcatgcaatggcatcactcttgagcgcacttgtgcaagtgatagaacagagaatctcaaatcaagctgataacctgaaaaaccaaaatatactcttcagggtacgtgaagataaatacaggtcaagaataaaggtcttagaaaccttggcagctggggcaactcaggaaaacgagattgtttcgaattgtatggagcgtacaaagcttgaaaaaagcagaatagaagaaagagaaaagtcagaagaaaaagatgtggtgcgtttgaaaaaggaaaaagagcgcagtgatgctgagattcgtaagctgaagcaagaactcaaggtggtgaaagaggcgcatgcaaaccagtgcttggagttagaagcaaaagcacaaaacagtacagttgagttggagagtaaattaaaggatgcagagttacaagttgccgaatcaactaggaaggtcaaagaactcgagaagttgtacctatctaaatctcaaaaatgggagaacagagagtccacctaccaaagcttcatagacaaccagtttggtgctttgcaggctttgaatgctacttcagtgtctataaagcaagaagtcttaaggacacaaaagaaatactttgaggacctaaattactatggtttaaagctcaaaggagtggctgatgcagcaaaaaattaccatgtggtccttgaagaaaaccgaagactgtacaatgaagtgcaggaattgaaaggaaatatcagagtctattgccggataagaccattccttccggggcaaaacagtggacagacttctatagagtacattggtgagaacggtgaattggtggttgcaaatccgtttaagcaagggaaagatacccatcggttgtttaagttcaataaagttttcggtcaagcagcaactcaagaggaggttttcctagatactcgaccattaattcgatcaattcttgatggttataatgtgtgtatatttgcgtatggtcagacgggatctggaaaaacttatacaatgagtgggccaagcatcacttcaaaagaacactggggtgtcaattacagagctctgaatgacttgtttcacttaactcagcttagacaaaacactgttgtgtatgaagtaggtgttcaaatggttgagatatacaatgagcaagttcgtgacatactttctgatgaaaatttccttaacttgcgtacattaggggtttggaatactgccttaccaaatgggttagctgtcccagatgcaagcatgcattctgtgagatcaactgaagatgtgcttgagctgatgaatattgggctcatgaacagaaccgttggtgccacagctctcaatgaaaggagtagtagatcacactggattatagaaatgacattgttgcctattgtatacagcgttctttctgttcatgtacgtggtgtcgacgtggaaaccgattctgttttgcgtggtagtttgcacttggtcgatcttgctggaagaggacaggctaagactcttatgtttgttcaagtcaatcctgatggagattcttatgctgagacggttagcactctgaagttcgctgaaagagtttctggtgtggaattaggtgcagctaaaagtaataaagagggacgagatgttagacacctcatggaacaggtatcaagcttgaaggatgttattgccaagaaagatgaagagcttcaaaatgttcagaagcaaaaaagtaacagtacaaccgtgccgaaacgtggtttaagcaatctaagattgttggggccttcatcacctagaagacactctataggaccttcaccaaatgctcgacgaggaaaggcacctggttcttttgggagagcagcctcagattttgacaactgctcagaatacagtagcaagcattctgattccggttcaccgcgttcatcggacgaacttaaacatcgaaaggatcttcaccagctatctaagtttgccggtgggtcaaaagaaattgacattgaagatgacattgaactcattggccttggggatgcagattctgaggacagattgagtgatatctctgatagctgtctttcgatgggaacagaaactgatggctccatatgcagtgcagtcgagttgactcttttccctgaaaccgtgaagcctcttgaaataacggaagaacctgaaccacacttggtccctgagaagctcgagaaatcagcaaagatggtgaaaaccgtgcccaaagacaagactcgcacttggagctaccaactctttgcgagtttctacggacccgacgtccctaagacttttatcagtcatttgcggagacagttaaacagcaaggggattttaatgttcgatgatcaagggactgagagaggccaagctattaggggatcagtgatatcgatcgtggtgctttccaagaattatgcttcttccagctggtgtttgaaaaacctgctggagattttgaagtgcaaggaacaaatcgtgacgacagttttctacggagtagatccatccgatgttaggaaacagactggagatttcgggaaagctttcaaggaaacatgtcgtggtagcaaagatggagacaagctttaa

SEQ ID NO: 39 - protein, 89 aa, Raphanus sativum
MIRDFAADKVALRASPTRNFILRANDPQNEGLKSSKLVVKLRYPARYPTSSASKSHKRTKTHLIKLTQRQRSALKKIQRKQLFKASSFD

SEQ ID NO: 40 - DNA, 270 bp, Raphanus sativum
atgatacgtgattttgctgccgataaagttgctctaagagcatctccaacaaggaacttcattttaagggccaatgatcctcaaaatgagggtttgaagagctctaaacttgtcgtcaaactcagatatccggcgagatacccgacatcatcggcgagcaaatctcacaaaagaacaaaaacccatcttattaaattgacgcagcggcagcgttcggcgttaaaaaaaatacaaaggaaacagctttttaaggcatcctcgtttgattga

SEQ ID NO: 41 - protein, 645 aa, Raphanus sativum
MRRRERRASGGSGGNGGGATGERTSTGGYSYGSVSAGENRMMPENLKKHLAVSVRNIQWSYGIFWSVSASQPGLLEWGDGYYNGDIKTRKTVQASEVKADQLGLERSEQLRELYESLSLAESSTSCGSQVNRRASASSLSPEDLTDTEWYYLVCMSFVFNIGEGVPGGVLANGQPIWLCNAHTADSKVFTRSLLAKSASLLTVVCFPFLGGVLEIGTTEHVAENLNVIQCVKTLFLEAPHGTLSTRSDYQEIFDPLSHDKYIPVFGTEAFPTTSTSVYEQEPDDHDSFINGGGASQVQSWQFVGEELSNCVHQPLNSSDCVSQTFVGTTGRVTCGPRKSRNQRLDQIQEQNNRVNMDDDVHYQGVISTIFKTTHQLVLGPQFQNFDKRSSFTRWRRSSLSAKTLGEKSQNMLKKIISEVPRMHQKKALLPDTPEDSGFKVGDETANHALSERKRREKLNDRFITLRSMIPSISKTDKVSILDDTIEYLQELQRRVQELESCRESDGKEMRMAMKRKKMEDEDERVSANCLKSKRKESESDVNVEEDEPADTGYAGLTDNLRIGSFGNEVVIELRCAWREGILLEIMDVISDLNLDSHSVQSSTGDGLLCLTVNCKVQLLTQAKFLLPNRNLSKPKLIYILMLIAA

SEQ ID NO: 42 - DNA, 1938 bp, Raphanus sativum
atgcgaagaagagaaaggagagcgtctggagggtctggaggtaacggcggaggagcgacgggagagagaacttcaaccggaggatactcgtacggcagcgtatctgcaggagaaaacagaatgatgccggaaaatctaaagaagcacctcgctgtttcagttcgaaacattcaatggagttacggaatcttttggtctgtctctgcttctcaaccaggactgttggagtggggagatggatactacaatggagacattaagactaggaagacggttcaagcatcggaagtcaaagctgaccagttgggtcttgagagaagtgagcagcttagagagctttacgaatctctctccctagcggagtcttcaacctcctgtggttctcaggtcaatagacgggcttccgcctcctctttgtctccggaagatctcaccgacactgagtggtattacttagtatgcatgtctttcgtcttcaacattggtgaaggagttcccggaggagtgttggcgaacgggcaaccaatatggttatgtaacgctcataccgccgatagtaaagtcttcactcgctctcttcttgctaaaagtgcttcgcttttgacagtggtttgcttcccatttcttggaggagttcttgagatcggcacgaccgaacatgttgcagagaacttaaacgtgatacaatgcgtgaagacattgttccttgaagctcctcatggaactttatcaacgagatccgattatcaagaaattttcgatcctttaagccacgataaatacattccagtgtttggaactgaagcttttccgacaacttccacaagcgtgtatgagcaagaaccagatgatcatgattcgttcatcaacggtggtggtgcatcccaggtacaaagctggcagtttgtgggtgaagaactcagtaattgcgttcaccaaccgcttaattctagcgattgcgtttcccagacttttgttggaacaaccgggagagttacttgcggtccaaggaagagtaggaatcaacggttagatcagattcaagaacagaataaccgagtaaatatggacgacgatgttcattaccaaggcgtgatctcgacgattttcaaaacaacgcatcagctagttcttggaccgcagtttcagaactttgataagcggtctagtttcacacggtggaggaggtcatcattgtctgcaaaaacgttgggagagaagtcgcaaaatatgttaaagaagattatatccgaggttcctcggatgcaccaaaagaaggcgttgttaccagacacaccagaagatagcgggtttaaggttggggatgaaaccgcgaaccacgccttgtccgagaggaaacgccgcgagaaattgaatgatcggttcataacgttgagatcaatgattccttcaattagtaagaccgataaggtgtcgattcttgatgatacgatcgagtatcttcaagaacttcaaagacgggttcaagaattggaatcttgcagagaatctgacggtaaagaaatgcgaatggctatgaaaaggaagaaaatggaggatgaagatgaaagagtatcggcgaattgtttgaaaagcaagaggaaggagagtgagagtgatgtgaatgttgaagaagatgaaccggctgataccggttatgctggtctaacagataatttaaggatcggttcgtttggcaatgaggtggttattgagcttaggtgtgcttggagagaagggatattgcttgagataatggatgtcattagtgatctcaatttggactctcactcggtacagtcttcaaccggggatgggttattgtgtttaactgtcaattgcaaggtacagctactaacacaagctaaatttctgttacctaaccggaatttgagtaaaccgaaactgatatatattttaatgctgattgcagcataa

SEQ ID NO: 43 - protein, 785 aa, Raphanus sativum
MEKRRSPRSSKSPGTPIFPKSPLVYESYKSGCGWKLINFFDFRHVKSGNKRLSSQKKPIRDSAGNVYTKSQLDLLKRLHERCQCHDRIVEGENSCKPKTRRRSFSSEREDESYESKPVQGLLEREIKRIKNAKEETSLSEVEKAKQMDLKNGRDCKKKSSEINLQVCVNEAAETLISSKAEEKGKDRSKQFMEALDILSSNKELFITLLQDPNSFSAKKGQDLERPHVKERRDKSPSLADDLDEIVLLKPRLPSLVDDRKYLRFKHLTKKLKLVVGSNKDTEASGDVSSSAVGYRSPESPVFRRKKRVESDVFKLSIEKDVSPRRFTVERQQERSDSSPVYEVPKALSSLQTKLKERRERLEKRRESFKLWSLDKEDLEVFDPNPHSYNVRSLSEKTSLRAPVEDGLEEDRYLESSSAESSIKRQEQEQPSPVSVLERIHMLDETVGLRNKEQIGLLSFDLVEKDSVHEFVKQLLQASRLNWTNLMARCNEETSLLDEFSHGNHNNDQLLLVLDYTDEILREIYRQDIKFWPFKPSQSSRVVNVPASFREEDLIHETLRRFDWSLLCCDSPKALDQVVEADLIKPSCLWLDCGGEAEGVVSDVVENIMQGLVVEISHELRTMQIRLQVSHRFCVVYGIVPRGPLDLSTAPDKTRLHGEAIDFITNLQDVHKLAQSHLESATTKYKLAADTKRCELIFEPGDLVWVYLTKERLPLRDYNKLKSKKLGPVEVVERINPNVYRVRLPSHLRTSDVFNIKHLSPFKGDNDDPDSWANPSQPGGPDAAAS

SEQ ID NO: 44 - DNA, 2358 bp, Raphanus sativum
atggagaaaaggagatcaccaagaagcagcaagagtcctggaactccaattttccctaaaagccctcttgtctacgagagttacaagtctggttgtggttggaaactgattaacttcttcgatttcagacatgttaaatctggtaataagagactgagttcacagaagaaacccatcagagactctgctggtaatgtttatactaaaagccaacttgatttgctcaagagacttcatgagagatgtcagtgtcatgatcggattgtggaaggagagaactcatgtaagcctaaaacgaggagaagatcctttagttctgaaagagaagacgagagctatgaatcaaaacctgttcagggtttactagagagagagataaagaggatcaagaatgcaaaggaggaaacttctttgagtgaagttgagaaggctaagcaaatggatctgaagaatgggagagattgtaaaaagaagagctcagagattaaccttcaagtttgtgtgaatgaagctgctgaaacattgatcagttccaaggcagaggagaaaggaaaagaccggtccaagcagttcatggaagcattagatattctaagctcgaacaaagagttgttcattacactcttacaagatcctaactcgttctcagccaaaaaaggtcaagacttggagagacctcatgtgaaggaacggcgtgataaatctccttcactggctgatgatttggatgagatcgttctcttgaagcctagactaccaagcttggttgacgacagaaagtacttgagattcaaacatctaaccaagaagttgaagcttgttgttggatctaacaaagacaccgaggcttctggcgatgtttctagcagtgcagttggctatagaagcccggagtcaccagtgtttaggcgcaagaaacgtgttgagtctgatgtcttcaagctaagcattgagaaggatgtttcgccaaggaggttcacagtggaaaggcaacaggagagatcagattcttcaccggtttatgaagttcctaaagcactgagtagcttacagacaaaactcaaagagagaagagagaggctggagaagagaagagagagcttcaagttgtggtccttggacaaggaggacttggaggttttcgatccaaatccgcacagctacaatgtaaggtctctcagtgagaaaacaagcctgagagctcctgtagaagacggactagaggaagatagatatctagagagctcatcagctgagtcgagtataaaaagacaggaacaagagcaaccgagtcctgtctctgtactagagaggattcatatgttagatgaaacagttggcctcagaaacaaagagcagattggactgttatcttttgatcttgtcgagaaagactctgttcacgagtttgtgaagcaacttctccaagcttcaagactgaactggaccaatcttatggcgagatgcaacgaagaaacatcactactagacgaattctcacacggtaatcacaacaacgaccagcttcttcttgttcttgactacacagacgaaattctccgcgagatttaccgtcaagacatcaagttttggcctttcaagccgtctcagagctcgagagtcgtcaatgtaccagcttcctttagagaagaagatctgatacatgagacgttgagacgttttgactggagtttactctgctgtgactctccaaaagcattggatcaggtcgttgaggctgatctgataaagccatcatgtctttggttggattgtggtggtgaagctgaaggtgtagtctctgatgtcgttgaaaatattatgcaagggttggtggttgagatatctcatgagctaagaacaatgcagattaggttacaggtttctcaccgtttttgtgttgtgtatggtattgttcctcgtggtccgttggatctttcgactgcaccagacaaaactcgccttcatggagaggccattgactttattaccaaccttcaagacgtccataagctcgcgcagtctcatttggaatcggctacgactaaatacaaacttgcagcagacaccaagcgttgtgagctgatcttcgaaccaggtgatctcgtttgggtgtacttaactaaagaacgactccccttgcgtgattacaataaattgaagtctaaaaagcttggtccagtcgaagtggtggaacgcatcaatccgaatgtgtatcgtgtcaggttgccttcacaccttcgtacgtctgacgtcttcaacatcaagcatttgtctccgttcaaaggcgacaatgatgatccagattcgtgggcaaatccttctcaaccgggaggacctgatgcagcagcatcataa

SEQ ID NO: 45 - protein, 871 aa, Raphanus sativum
MGPLTIKEAFSLVLEKEGEEEEDEIFRILGSSDRRNIDTIRIFEGPRFGSGPDISWAILVGLVIITPNPPRITNTRNAPYCRLATKKNSYPLRKTFLHHTPSPVSPMAFTFFSPHPVFLSLGRTTSSFSSYKPAYSPFSRNPRNNLQLAAGPTRRSSYPNPADDDPPEAPEDSMHGVSKFQQIQRQAARARKLEEEDFEKNRNTYLSAIADVEDAPETGRDDVESGGDLFSDIDRAISMKRSEFVKKGLLQPNPPKTASSKKIDEEEEEDDAVDELDEEEAVDLDEIDKLTGLTEASDEEDWVDEEGNPRIISKKKEHQFEFDLDDFGESKARIVEPKFRLSLAELLDESKVVPISVYGDLDVEITGIQHDSRGVSAGDLFVCCDGGDDSVLSEADKRGAVAVVASKEIDIEDTLGCRALVIVEDTEAVLAALASSFYRHPSKDMAVIGVTGTNGKTTTTYLIKSLYEAMGVRTGMFSSVSCYVHGDNKMDSTTTSPDAVLVQSMMAKMLHNGTEALVMEASPQELASGKCDEVDFDIAVFTNLAREDSGFRGTDEEYRDAEAKLFARMVDPERHRKVVNIDDPNAAFFVQQGNPDVPVVTFAMENTKADVHPLKFELSLFETQVLLNTPQGILEISSGLLGRHNIYNILAAVAVGIAVGAPLEDIVRGVEEVDAVPGRCELIDEEQAFGVIVDHANTPDGLSRLLDSVRELKPRRIITVIGCAGETERGKRPVMTKIATEKSDVTMLTSDNPGNEDPLDILDDMLAGIGWTMQEYLKHGEHDYYPPLANGHRLFLHDIRRVAVRCAVAMGEEGDMVVVAGKGHEAYQLEGDKKEFYDDREECREALQYVDELHQAGIDTSEFPWRLPESH

SEQ ID NO: 46 - DNA, 2616 bp, Raphanus sativum
atgggtcctctcaccattaaagaggcttttagtctcgtcctggagaaggagggagaggaggaggaagatgaaatatttcgaattttaggtagttcggatagaagaaatatagacaccatacggatatttgaaggtcctcggttcggttcgggtccggatatttcgtgggctattttggtgggcttggtcattattacgccaaacccacctcgtatcactaacactcgaaacgcaccgtattgtcgtttggcaacaaaaaaaaactcttatccccttcgaaaaacctttcttcatcacactccctctcctgtctctccaatggccttcactttcttctctcctcaccccgtcttcctctctctaggtcgaaccacctcttccttctcctcctacaaaccggcatactcaccattctcccgaaatccccgtaataatcttcagttagcggcgggccccacccgtcgtagctcttacccgaacccggcggatgacgacccgcccgaagccccggaggattcgatgcacggcgtctccaagtttcagcagatacagcgccaagccgctcgagcgcggaagctggaggaagaagacttcgagaagaaccgaaacacgtacctctcggccatcgctgacgtggaagacgcgcccgagacgggacgcgatgacgtggagtctggaggcgatctgttctcggacatcgatagagccatctcaatgaaacgtagcgagttcgttaaaaaaggactgctccaacctaaccctcccaaaacggcgtcgtctaagaagatcgacgaggaagaagaagaagacgacgctgttgatgagcttgacgaagaagaagctgtggatttagacgagatcgataaactgactggattaaccgaagcttccgacgaagaagactgggtcgacgaggaagggaaccctaggatcatcagcaagaagaaggagcatcaattcgagttcgatttggatgatttcggcgaatccaaggcgagaatcgtggagcctaagttcagactgagcttagccgagctcttggacgagagcaaagtggtgccgatctcagtctacggcgacttagacgtcgagatcaccggaatccagcacgattcgcgaggcgtaagcgccggagatctcttcgtgtgctgcgacggaggagacgactccgtcctgagcgaagctgacaagagaggagcggtggcggttgtggctagcaaagagatcgatattgaagatacgttaggctgtagagcgctcgtcatcgtcgaagacaccgaagcagtcttggctgcgttagcttcttcgttttataggcatccgtcgaaggacatggcggttatcggagtcacggggactaacgggaagacgaccaccacgtatttgattaaaagcctctatgaagctatgggtgtgagaacaggaatgttcagcagtgtttcttgttacgtccatggagataacaagatggattcaacgacgacgagtcctgatgctgttttggttcagagtatgatggcgaagatgttgcataatggaaccgaagctctggttatggaagcttctcctcaagaactcgcttcagggaaatgcgacgaagttgatttcgacattgcggtcttcacgaatttagccagagaggatagtggctttcgcggtactgatgaggagtatagagatgctgaagccaagttgtttgcaagaatggtcgacccggaaagacacaggaaagtggttaacattgacgatccaaacgcagcgtttttcgtccagcaagggaaccctgatgttcctgttgtgacgtttgcaatggagaacacgaaagcggatgttcacccgttgaagtttgagctgtctttgtttgagacacaggttttgctcaatacacctcagggtatactggaaatttcgtctggtttgttaggacggcataacatttataacattcttgctgctgttgctgtcgggatagctgtcggagctcctcttgaggatattgttagaggtgttgaggaagtcgatgctgtcccggggaggtgtgagttgattgatgaggaacaagcttttggtgttattgtggatcatgctaacacacctgatggtttgtcaaggctgcttgattcggttcgagagcttaagccaagaagaatcattactgttattggctgtgcgggtgagactgagagagggaaacgaccggttatgacgaaaatcgcaactgaaaagagtgatgtgacgatgttgacatctgataatccggggaatgaagatccattggacatattggatgacatgttggctgggattggatggacgatgcaagagtatctgaaacacggagaacatgattactatcctccattggcaaatggtcatagactcttccttcacgacattagacgtgtagctgtgcgttgtgctgttgcgatgggtgaagaaggtgacatggttgtggtagcagggaaaggccacgaagcgtatcagcttgaaggtgataagaaagagttctatgatgatcgagaggaatgtcgggaagcattacaatacgttgatgagcttcatcaagctggaatagacacaagcgagttcccatggaggttaccagagagtcattaa

SEQ ID NO: 47 - protein, 686 aa, Raphanus sativum
MLARVCRFESSSSSSVSAARFFCTGSIRHALAEKSRDGESGEAGFRGESLKLRSGSYEIKGLEDAIDLFSDMLRSRPLPSVIDFNKLMGAVVRMERPDLVISLYQKMERKQIRCDIYSFTILIKCFCSCSKLPFALSTFGKLTKLGLHPDVVTFTTLLHGLCLDHRVSEALDLFHQICRPDVLTFTTLMNGLCREGRVVEAVALLDRMVENGLQPDQITYGTFVDGMCKMGDTVSALNLLRKMEEISHIKPNVVIYSAIIDGLCKDGRHSDSHNLFIEMQDKGIFPNIVTYNCMIGGFCISGRWSAAQRLLQEMLERKISPNVVTYNALINAFVKEGKFFEAAELYDEMLPRGIIPNTITYNSMIDGFCKQDRLDAAEDMFYLMATKGCSPDVFTFTTLIDGYCGAKRIDDGMELLHEMPRRGLVANTVTYNTLIHGFCLVGDLNAALDLSQQMISSGVCPDIVTCNTLLDGLCDNGKLKDALEMFKAMQKSKMDLDASHPFNGVEPDVLTYNILICGLINEGKFLEAEELYEEMPHRGIVPDTITYSSMIDGLCKQSRLDEATQMFVSMGSKSFSPNVVTFNTLINGYCKAGRVDDGLELFCEMGRRGIVADAIIYITLIYGFRKVGNINGALDIFQEMISSGVYPDTITIRNMLTGFWSKEELERAVAMLEDLQMSVGYQLEDE

SEQ ID NO: 48 - DNA, 2061 bp, Raphanus sativum
atgttggctagggtttgcagattcgagtcttcctcttcgtcttctgtgtctgcggctagatttttctgtacgggatcgattcgtcatgctctggccgagaaaagcagggatggagagagtggcgaagcaggttttagaggagagagtttgaaactgcgaagtggatcttatgaaatcaaagggttagaggatgcgattgatttgttcagtgacatgcttcgatctcgtcctttaccttctgtgattgatttcaacaagctaatgggtgcggtggtgagaatggaacgcccggatcttgtgatttctctctatcaaaagatggaaaggaaacagattcgatgtgatatatacagcttcaccattctgataaaatgtttctgcagttgctctaagctcccctttgctttgtctacatttggtaagctcaccaagcttggactccaccctgatgttgttaccttcaccaccctgctccacggattatgtcttgatcacagggtttctgaagccttggatttgtttcatcaaatttgtagaccagatgtcctaacgttcaccacgctgatgaatggtctttgccgcgagggtcgagttgtcgaagccgtagctctgcttgatcggatggtggaaaatggtctccagcctgaccagattacttacggaacatttgtagatgggatgtgtaagatgggcgacactgtgtctgcattgaatcttctgaggaagatggaggagataagccacatcaaacccaatgtggttatctatagtgccatcattgatggcctttgtaaagatggacgccatagcgattctcataatcttttcattgaaatgcaagacaagggaatctttccaaatatagttacctacaactgtatgatcggtggattttgcatctctggtagatggagtgcagcccagcggttgttgcaagaaatgttagaaaggaagatcagccctaatgttgtaacttataatgctttgatcaatgcatttgtcaaggaaggcaagttcttcgaggctgcagaattatacgatgagatgcttccaaggggtatcattcctaatacaatcacatataattcaatgatcgatgggttttgcaaacaggatcgtcttgatgctgctgaggacatgttttatttgatggctaccaagggctgctctccggacgtattcactttcactactctcatagacggatattgtggggctaagaggatagatgatggaatggaacttctccatgagatgcctagaagaggattagttgctaacacagttacttacaacactcttattcacgggttctgtctggtgggcgatcttaatgctgctctagacctttcacagcagatgatttctagtggtgtgtgccctgatatcgttacttgtaacactttgctggacggtctctgcgataatgggaaactaaaagatgcattggaaatgtttaaggctatgcagaagagtaagatggatcttgatgctagtcaccccttcaatggtgtggaacctgatgttctaacttacaatatattgatctgcggcttgatcaatgaagggaagtttttagaggccgaggaattatacgaggagatgccacacagaggtatagtcccagatactatcacctatagctcaatgatcgatggactatgcaagcagagccgcctagatgaggctacacaaatgtttgtttcgatgggtagcaagagcttctctcccaacgtagtgacatttaacacactcattaatggctactgtaaggcaggaagggttgatgatgggctggagcttttctgcgagatgggtcgaagagggatagttgctgatgcaattatttacatcactttgatttatggttttcgtaaagtgggtaatattaatggggctctagacattttccaggagatgatttcaagtggtgtgtatcctgataccattactatccgcaatatgctgactggtttttggagtaaagaggaactagaaagggcagtggcaatgcttgaggatctgcagatgagtgtggggtatcagttggaggatgaatga

SEQ ID NO: 49 - protein, 208 aa, Raphanus sativum
MNLGQNQPRTRSYSTLLAQTNQNPSATECSGCQPPRRSNLGRIKIRVHILVLERHASRRPAHHHRFTLPPGNHTSVHRNPTGAHKLHTSSSRTLFRSRMALIGESINRRYEISSPVVYRTHPRERFTCITNLPAGDLHPPPTRPRSTKPKRTTKRRKEKKKNLNPNKLGAESRRRKTVEIITPRRLEPMTVEPKRLPRRGYEGRRRWS

SEQ ID NO: 50 - DNA, 627 bp, Raphanus sativum
atgaaccttggccagaatcaacctcgtacccggtcttactcaactcttttagcccaaacaaaccaaaaccctagcgctacggaatgctcgggatgtcagccgccgcgtagatctaaccttgggagaatcaagatacgtgttcacatcctcgtcctcgagagacacgcgtcacgcaggccagcacaccaccaccgcttcacgctaccaccggggaaccacacctcagttcaccggaacccaaccggagctcacaaactccacacatcctcatcgcgaacactttttcgatctaggatggctctaatcggagagagcatcaatcgtcgctacgagatctcatcccccgtagtttatcgcacacaccctagagaacgcttcacatgcatcaccaaccttcccgccggagaccttcaccctcctccgacgagaccacggtcaaccaaacccaaacgaaccacaaagagaagaaaagaaaaaaaaaaaaacctaaaccctaataaactaggagccgaaagccggcggcgcaagacagtggagatcatcacaccccggagactagaaccgatgacggtggaaccgaagaggcttccccgtcgcggatacgaaggccggcgtcgatggagctaa

SEQ ID NO: 51 - protein, 804 aa, Raphanus sativum
MEAPNYPIFFGLNLGVPLEGGRSGTYSGFGSSLFGFRIFGVKDFSPIRLFLNYGSGSVRILADSSRVFFRDRRRTKFRRNKNKMLARVCGFKCSSSPAESAARLFCTRSIRDTLAKASGESCEAGFGGESLKLQSGFHEIKGLEDAIDLFSDMLRSRPLPSVVDFCKLMGVVVRMERPDLVISLYQKMERKQIRCDIYSFNILIKCFCSCSKLPFALSTFGKITKLGLHPDVVTFTTLLHGLCVEDRVSEALDFFHQMFETTCRPNVVTFTTLMNGLCREGRIVEAVALLDRMMEDGLQPTQITYGTIVDGMCKKGDTVSALNLLRKMEEVSHIIPNVVIYSAIIDSLCKDGRHSDAQNLFTEMQEKGIFPDLFTYNSMIVGFCSSGRWSDAEQLLQEMLERKISPDVVTYNALINAFVKEGKFFEAEELYDEMLPRGIIPNTITYSSMIDGFCKQNRLDAAEHMFYLMATKGCSPNLITFNTLIDGYCGAKRIDDGMELLHEMTETGLVADTTTYNTLIHGFYLVGDLNAALDLLQEMISSGLCPDIVTCDTLLDGLCDNGKLKDALEMFKVMQKSKKDLDASHPFNGVEPDVQTYNILISGLINEGKFLEAEELYEEMPHRGIVPDTITYSSMIDGLCKQSRLDEATQMFDSMGSKSFSPNVVTFTTLINGYCKAGRVDDGLELFCEMGRRGIVANAITYITLICGFRKVGNINGALDIFQEMISSGVYPDTITIRNMLTGLWSKEELKRAVAMLEKLQMSMVYYWSELKRHTFQKISGVKRCLGVCPFCSCHHGYRQARSS

SEQ ID NO: 52 - DNA, 2415 bp, Raphanus sativum
atggaggcaccaaattatcctatattttttggacttaatcttggtgtacccctagagggtgggcgttcgggtacctattcgggtttcggttcgagtctattcggatttcggatttttggggtcaaagattttagccccattcggttatttctaaattacggttcgggttcggttcggatccttgcggattcgtcacgagttttttttagagatcgacgaagaacaaaatttaggcgaaacaaaaataaaatgttggctagggtttgtggattcaagtgttcttcttctcctgctgagtctgcggctagattgttctgtacgagatcgattcgtgatactctggccaaggcaagcggagagagttgcgaagcaggttttggaggagagagtttgaagctgcaaagtgggtttcatgaaatcaaaggtttagaggatgcgattgatttgttcagtgacatgcttcgatctcgtcctttaccttctgtggttgatttctgtaaattgatgggtgtggtggtgagaatggaacgcccggatcttgtgatttctctctatcagaagatggaaaggaaacagattcgatgtgatatatacagcttcaatattctgataaaatgtttctgcagctgctctaagctcccctttgctttgtctacatttggtaagatcaccaagcttggactccaccctgatgttgttaccttcaccaccctgctccatggattatgtgtggaagatagggtttctgaagccttggatttttttcatcaaatgtttgaaacgacatgtaggcccaatgtcgtaaccttcaccactttgatgaacggtctttgccgcgagggtagaattgtcgaagccgtagctctgcttgatcggatgatggaagatggtctccagcctacccagattacttatggaacaatcgtagatgggatgtgtaagaagggagatactgtgtctgcactgaatctgctgaggaagatggaggaggtgagccacatcatacccaatgttgtaatctatagtgcaatcattgatagcctttgtaaagacggacgtcatagcgatgcacaaaatcttttcactgaaatgcaagagaaaggaatctttcccgatttatttacctacaacagtatgatagttggtttttgtagctctggtagatggagcgacgcggagcagttgttgcaagaaatgttagaaaggaagatcagccctgatgttgtaacttataatgctttgatcaatgcatttgtcaaggaaggcaagttctttgaggctgaagaattatacgatgagatgcttccaaggggtataatccctaatacaatcacatatagttcaatgatcgatggattttgcaaacagaatcgtcttgatgctgctgagcacatgttttatttgatggctaccaagggctgctctcccaacctaatcactttcaatactctcatagacggatattgtggggctaagaggatagatgatggaatggaacttctccatgagatgactgaaacaggattagttgctgacacaactacttacaacactcttattcacgggttctatctggtgggcgatcttaatgctgctctagaccttttacaagagatgatctctagtggtttgtgccctgatatcgttacttgtgacactttgctggatggtctctgcgataatgggaaactaaaagatgcattggaaatgtttaaggttatgcagaagagtaagaaggatcttgatgctagtcaccccttcaatggtgtggaacctgatgttcaaacttacaatatattgatcagcggcttgatcaatgaagggaagtttttagaggccgaggaattatacgaggagatgccccacaggggtatagtcccagatactatcacctatagctcaatgatcgatggattatgcaagcagagccgcctagatgaggctacacaaatgtttgattcgatgggtagcaagagcttctctccaaacgtagtgacctttactacactcattaatggctactgtaaggcaggaagggttgatgatgggctggagcttttctgcgagatgggtcgaagagggatagttgctaacgcaattacttacatcactttgatttgtggttttcgtaaagtgggtaatattaatggggctctagacattttccaggagatgatttcaagtggtgtgtatcctgataccattaccatccgcaatatgctgactggtttatggagtaaagaggaactaaaaagggcagtggcaatgcttgagaaactgcagatgagtatggtatattattggtctgaactaaagaggcacaccttccagaagatttcaggtgttaaaagatgtttaggtgtctgcccgttctgtagctgtcaccatggttatcgtcaagctcggtcttcatga

SEQ ID NO: 53 - protein, 654 aa, Raphanus sativum
MLARVYRSGSSSSPAVSAARLFCTRSIRHALAKKSRDGESGFGGESLKLRSGFHEIKGLEDAIDLFGDMVRSRPLPSVIDFCKLMGVVVRMGRLDVVISLHRKMEMRRVPCNAYSFTILMKCFCSCSKLPFALSTFGKITKLGFHPTVVTFSTLLHGLCVEDRISEALDLFHQMCKPNVVTFTTLMNGLCREGRVVEAVALLDRMLEDGLQPNQITYGTIVDGMCKMGDTVSALNLLRKMEEVSHIKPNVVIWPLERRTCMINGFCSSGRWSEAQQLLQEMLERKKISPDVVTYNALINAFVKEGKFFEAEELYDEMLPRGIIPSTITYSSMIDGFCKQNRLDAAEHMFYLMATKGCSPDIITFNTLIAGYCRAKRVDDGIKLLHEMTEAGLVANTITYTTLIHGFCQVGDLNAAQDLLQEMVSSGVCPNVVTCNTLLDGLCDNGKLKDALEMFKAMQKSKMDIDASHPFNGVEPDVQTYNILISGLINEGKFLEAEELYEEMPHRGIVPDTITYNSVIHGLCKQSRLDEATQMFDSMGSKSFSPNVVTFTTLINGYCKAGRVDDGLELFCEMGRRGIVANAITYITLIHGFRKVGNINGALDIFQEMMASGVYPDTITIRNMLTGLWSKEELKRAVAMLEDLQMSVGYQLEDE

SEQ ID NO: 54 - DNA, 1965 bp, Raphanus sativum
atgttggctagggtttatagatccggatcttcttcttctcctgctgtgtctgcggctagattgttctgtacgagatcgattcgtcatgctctggccaagaaaagcagggatggagagagtggttttggaggagagagtttgaagctgcgaagcggatttcacgaaatcaaagggttagaagatgcgattgatttgttcggtgatatggtacgatctcgtcctttaccttcagtaattgatttctgtaaattgatgggagttgtggtgaggatgggaaggctcgatgttgtgatttctctccataggaagatggaaatgaggcgggttccatgtaacgcatacagcttcaccatcctgatgaagtgtttctgcagctgctctaagctgccgtttgctttgtctacatttggtaagatcaccaagcttggttttcatcccactgttgttaccttcagcaccctgctccacggattatgtgtggaagacaggatctctgaagccttggatttgtttcatcaaatgtgtaaaccaaatgtcgtaaccttcaccacgctgatgaacggtctttgccgtgagggtcgagttgtcgaagctgtagctctgcttgatcggatgctagaagatggtctccagcctaaccagattacttatggaacaatcgtggatgggatgtgtaagatgggagacactgtgtctgcattgaatcttctgaggaagatggaggaggtgagccacatcaaacccaatgtggtaatctggcctttggaaagacggacctgtatgattaatggattttgtagctctggtagatggagtgaagcccagcagttgttgcaagaaatgttagaaaggaagaagatcagccctgatgttgtaacttataatgctttgatcaatgcatttgtcaaggaaggcaaattctttgaggctgaagaattatacgatgagatgcttccaaggggtataatccctagtacaatcacatatagttcaatgatcgatggattttgcaaacagaatcgtcttgatgctgctgagcacatgttttatttgatggctaccaagggctgctctccggacataatcactttcaatactctcatagccggatactgtagagctaagagggtagatgatggaataaaacttctccatgagatgactgaagcaggattagttgctaacacaattacttacaccactcttattcacgggttctgtcaggtgggcgatcttaatgctgctcaagaccttctacaggagatggtctctagtggtgtgtgccctaatgtcgttacttgtaacactttgctggacggtctctgcgataatgggaaactaaaagatgcattggaaatgtttaaggctatgcagaagagtaagatggatattgatgctagtcacccctttaatggtgtggaacctgatgttcaaacttacaatatattgatcagtggcttgatcaatgaagggaagtttttagaggccgaggaattatacgaggagatgccacacagaggtatagtcccagatactatcacctataactcagtgatccatggtttatgcaagcaaagccgcctagatgaggctacacaaatgtttgattcgatgggtagcaagagcttctctccaaacgtagtgacctttactacactcattaatggatactgtaaggcaggaagggttgatgatgggctggagcttttctgcgagatgggtcgaagagggatagttgctaacgcaattacttacatcactttgattcatggttttcgtaaagtgggtaatattaatggggctctagatattttccaggagatgatggcaagtggtgtgtatcctgataccattactatccgcaatatgctgactggtttatggagtaaagaggaactaaaaagggcagtggcaatgcttgaggatctgcagatgagtgtgggatatcagttggaggatgaataa

SEQ ID NO: 55 - protein, 342 aa, Raphanus sativum
MRGGASGNNVLETINAAATAFASSDDRVHHQPSPIHRRKRIGKAALAPEPVPTDSTSNSGYRSVMTALPFIAPPSSPASFFQSEPPSATQSPVGILSFSPLPSNSHNNNNNSEERPSIFAIGPYAHEPQLVSPPVFSTYTTEPSSAPVTPPLDESFYLTTTTPSSPEVPFAQLFNSSSNYGVRSPVSNYEFQFYQLPPGSPLAQLISPSSVMSGSGATSPFPDGLAQFQVSDPPKLLSPGKLRCSKSVTTPKEQNKIVRPNKPVSFDLDADHFIRCVDKKLRTTFPEASDQEAAQHSSSGSNKEFDFGTTDEIHLTGDDEHRDSTKNSSDWSFPVMQSGTLS

SEQ ID NO: 56 - DNA, 1029 bp, Raphanus sativum
atgagaggcggcgcgagtggaaacaacgttttggagactataaacgcagccgctactgcgttcgcttcctctgatgatcgtgttcatcaccaaccttccccgattcatagaagaaaacgaatcgggaaagctgctcttgctcctgaaccggttcctaccgattccacatccaattccggttatcgttcggttatgacggctcttcctttcatagccccaccttcctctccagcttccttcttccaatcagaacctccttccgctacacagtcacctgtagggatcctctcctttagtcctctaccttctaacagccacaacaacaacaacaacagcgaagaacgtccttcgatcttcgccatcggaccttacgctcacgaacctcagctggtttctcctccggttttctctacttacacaaccgaaccgtcttcagctccggtcacgccgcctctcgacgagtctttctacttaaccaccaccacaccgtcttcgcctgaagtccctttcgctcagctctttaactccagcagtaactacggtgtcaggtctccggtgtctaactacgagtttcagttttaccaacttcctcccggtagtccactcgctcagcttatctcccccagctcggttatgtccggttctggtgcgacttctccgtttcctgacggactcgctcagtttcaagtctctgatccaccaaagctgctgagccctggtaaactgcgttgctccaagtctgttacaactcctaaagagcagaacaagattgtgagaccgaacaaaccggtttcgttcgatcttgatgcggatcatttcattagatgcgttgataagaagctgagaacaacgttccctgaagcgtctgatcaagaagcagctcaacattcctcctccggatccaataaagaattcgatttcggcaccaccgatgagatacatttgaccggtgatgatgagcatagagattcgaccaagaacagcagcgattggtccttccctgtgatgcaatcaggcacacttagctaa

SEQ ID NO: 57 - protein, 148 aa, Raphanus sativum
MKSSHRAKQVEIGFFWREITFFRFWRKITFFRFWRENAFSGFHEKLRFSGFGGKLRFSGFGGKITFSGFDEKLCFSGLDGKLRFSILVGNYVCRFWREIVFFGFDGKLRFLGFGVKVCFLVLARNWVFRFLVGNCLFPILAGYCIFRF

SEQ ID NO: 58 - DNA, 447 bp, Raphanus sativum
atgaagtcaagccaccgtgcaaaacaagttgaaattggctttttttggcgagaaattacgtttttccggttttggcggaaaattacgtttttccggttttggcgggaaaatgcgttttccggttttcacgagaaattacgtttttccggttttggcggaaaattacgtttttccggttttggcgggaaaattacgttttccggttttgacgagaaattgtgtttttccggtttggacgggaaattgcgtttttcgattttggtgggaaattatgtttgtcggttttggcgggaaattgtgtttttcggttttgacggaaaattgcgttttctcggttttggcgtgaaagtgtgttttttggtcttggcgagaaattgggttttccgatttttggtgggaaattgcctttttccgattttggcgggatattgcatttttcgattttga

SEQ ID NO: 59 - protein, 2100 aa, Raphanus sativum
MIRTEPEFQREVFKEEDLQHEQYRQICFLFSTTSQEVEIIECGVQIVRDRSGRKRSDADAVNINHNNNCWKTTMKVSTKEMKFPSKEVSPEQEESRTSQKRQQQGSIKSSSFRDFHRYSALMASSSSSSSPRTWRYRVFTSFHGPDVRKTFLTHLRKQFNCNGISMFDDQGIERGHTIAPALTQAIRESRISIVVLTKHYASSRWCLDELLGILKCKEEIGQIVMTIFYGVDPSDVRKQTGDFGKVFKDTCRRKTEEERRRWSQALTDVGNIAGEHFLNWDKESEMIEKIARDVSNKLNATISRDFEDMVGIEAHLDKMQSLLHLDDEDGAMFAGICGPAGIGKTTIARALHSRLSSSFHLTCFMENLRGSCNSGLDEYGLKLRLQELLLSKIFNQNDMRIYHLGAIPQRMCDQKVLIILDDVDDLQQLEALADETNWFGDGSRIVVTTEDQELLEQHGINNTYYVDLPTDDEARKIFCRYAFRRSLTPYGFETLVERTTELCGKLPFGLRVQFYAERKKTTGKIDAVLRVGYDSLHENEQTLFLLIAIFFNYQDDGHVKTMLADTNLDVRLGLKTLAYKSLTKISSQGKIVMHKLLQQVGRQAVQRQEPWKRRILIDPQEICDVLEPWKRQVLTDTDEIRDVLENDSGSRNLMGVSFDMSTILHDMDISARAFTSMRNLRFLKVYKTRCDTNVRVHLPEDMEFPPRLRLLHWEVYPRKFLPRTFCTEHLVELYLRDTELEQLWEGTQPLTNLKKMFLGSCLYLKELPDLAKATNLEKLRLDRCRSLVEIHSSVGNLHKLESLEVAFCYNLQVVPNLFNLASLESFMMVGCYQLRSLPDISTTITELSIPDTLLEEFTEPIRLWSHLQRLDIYGCGENLEQVRSDIAVERIPDCIKDLQRLEELTIFCCPKLVSLPELPRSLTLLIVYECDSLETLAPFPLGSEIEALSFPECFRLDREARRVITQLQSSWVCLPGRNIPAEFHHRVIGNFLAICSNAYRFKLCAVVSPKQVMVEDEDIELLCHILINGCPMKSPIKSIYNLRIRIQSEHLFIFPSTMLKEDRQLGQYSEILFKFSTTSQNTEIIKCGVQILRDRRSCDSKSEQDDDESLYSSLDYDAPRVDTINLLKEHKDLISDYFTSFFSLWCLDELLGILKCKEEMGQIVMTIFYGVDPSDVRKQTGDFGKVFKETCRRKTEEERRRWSQALTDVGNIAGEHFLNWDKESEMIEKIARDVSNKLNATISRDFEDMVGIEAHLDEMNSLLHLDDEDGAMFVGICGPAGIGKTTIARALHSRLSSTFQHTCFMENLRGSCNSGTDEYGLKLRLQELLLSKIFNQNGVKLFHLGAIKERLCDLKVLIVLDDVDDLQQLEALADDTNWFGDGSRIIVTTEDQEILEQHGISNTYRVDFPTQVDARQIFCRFAFRQLSAPHGFEKLVDRVIKLCSNLPLGLRVMGSSLRRKKVDDWEGILQRLENSFDQKIDAVLRVGYNSLHKDDQFLFLLIACFFNYKDDDHVKAMLVDSNLDVRLGLKNLVYKSLIQISAEGTIVMHKLLQQVGREAVHLQDPRKRQILIDSHQICDVLENDSDGTSVMGISFDTSTIPNGVYISAQGFRRMRDLRFLSIYETRRDPNVRVHLPEDMSFPPLLRLLHWEVYPGKCLPHTLRPEHLVELCFVNSMLEQLWQGVQPLTNLKKMDLSGSLSLKEVPDLSNATSLKRLNLTGCWSLVEIPSSIGDLHKLEELEMNLCVSVQVFPTLLNLASLESLRMVGCWQLSKIPDLPTNIKSLVVGETMLQEFPESVRLWSHLHSLNIYGSVLTVPLLETTSQEFSLAAATIERIPDWIKDFNGLRFLYIAGCTKLGSLPELPPSLRKLIVDNCESLETVCFPCDTPTTDYLYFPNCFMLCQEAKRVITQQSLRAYFPGKEMPAAEFDDHRSFGSSLTIIRPAICKFRICLVLSPAPDMEEAYFKLLFRIRAKGCPSDDDMLSLDLAKIQGEHLFIFHIEFVEHHEEMVFKFSTSSHEVDVIECGVQVLTDETSRRSNESCSEQVSEDGDDILSDDDKSNEIYEPRVKIFTGYTMFLSLVFTFLLSLISSLILYRFLKN

SEQ ID NO: 60 - DNA, 6303 bp, Raphanus sativum
atgataagaacagaacctgaatttcaaagagaagtgtttaaggaagaagacctacagcatgaacaatatcgccagatatgtttcctgttcagcaccacatcccaggaagtcgaaattattgaatgtggcgtccagatcgtgagggacagaagtggcagaaaaagaagcgacgccgatgctgtgaatataaatcacaacaacaactgttggaagacgacgatgaaagtctctacgaaagagatgaagtttccttcaaaagaagtctcgcctgaacaagaagaaagcagaacaagccaaaagcgacaacaacaaggatccataaaaagttccagtttcagagactttcatcgatactctgctctcatggcttcttcttcctcttcttcctcgcctcgcacatggagataccgcgtcttcacgagcttccacggacctgacgtccgcaaaaccttcctcactcacctacgcaagcagtttaactgcaacgggatatcgatgttcgacgatcaagggatcgagagaggccacaccatcgcccctgctctcacacaagcgatcagagaatcgaggatctctatcgtggtgttaacgaagcactatgcttcttccaggtggtgtttggatgagcttttggggattctgaaatgcaaggaagagatcgggcagatagtgatgaccatcttctacggagtagatccttccgatgttcggaaacaaaccggagatttcgggaaagtcttcaaggacacatgccgtcgtaaaacagaggaagagaggcgaagatggagccaagctttgaccgatgtgggaaacatagctggggaacactttctcaactgggacaaggaatcggagatgattgaaaagattgcgagagatgtctcaaacaagcttaatgctacaatctctagggattttgaagacatggttggtattgaagcacacttggataagatgcagtctttgttacatttagatgatgaggatggagctatgtttgctggaatctgtggccctgctggcattggtaagactaccattgctagggctctacatagtcgactctctagcagttttcatcttacttgttttatggagaatcttcgaggaagctgtaatagtggtctcgacgagtatggattgaaactgcgtttacaagagctacttctttcaaagatttttaaccagaatgatatgaggatataccatttaggtgcgataccgcaaagaatgtgtgaccaaaaagttcttatcattcttgatgatgtggacgatctgcagcagcttgaggctctggctgatgaaactaactggtttggtgatggaagcaggattgtggtgaccacggaagatcaagagcttttggagcaacatggtatcaacaatacatactatgtggatcttccgactgacgacgaggctcgtaagattttttgtagatatgctttcagacggagcttaacaccatatggttttgaaactcttgtcgaaagaacaacagagctttgtggcaaacttccttttggtctccgtgttcaattttacgcggaaagaaagaagacgactgggaaaatcgatgcagtacttagagttggatacgacagtttacatgagaacgaacaaactctgtttctcctcattgccatcttcttcaactaccaagacgatggtcacgtgaaaacaatgctcgctgacactaacttggatgtcagactcggcttgaaaactctcgcttataagtctctcacaaaaatatctagccaaggaaaaatagtgatgcacaagttactacaacaagtgggcagacaagcagttcaaagacaagagccttggaaacgtcggatcttaattgatcctcaagagatctgcgatgttcttgagccttggaaacgccaagtcctaactgataccgatgagattcgcgatgtccttgaaaatgattctggtagtagaaatttgatgggggtatcttttgatatgtctacaatcttacacgacatggatattagcgcaagagcttttacaagtatgcgtaatcttcgatttctcaaggtctacaaaacaagatgtgatacaaatgttagagtgcatttacccgaggacatggagtttccacctcgtctgaggttattacactgggaggtatacccgagaaagtttcttcctcgtacattttgtactgaacatcttgtggaactctatttaagagataccgagctcgagcaattatgggagggaacccagcccctcacaaatctcaagaagatgtttttgggttcgtgcctgtatcttaaggaacttccggatcttgcaaaagctacaaacctagagaaattgaggttggatcggtgcaggagtttggtagagattcattcctctgttggaaaccttcataaactagagagtttggaagtggctttctgttataatctacaggttgttccgaatcttttcaacttggcatctcttgaatcattcatgatggtgggatgctaccaactgaggagtcttccagatatttctacgaccatcacagaactctcaatcccagacacactgttagaagagtttactgaaccaattaggctctggtctcaccttcagagactcgatatatatggctgtggggaaaatttggagcaagtgcgaagtgacatagctgttgagagaattccagactgcatcaaagatctccaacggttagaagaactaactatattttgctgtccaaaacttgtatcactgccagagctccctaggtcgctcacattactaatagtatacgaatgtgattcactggagacactagcacctttccctttaggttctgagattgaagctctctcttttcccgaatgcttcagattggatcgagaagcaaggagagtaattacccagctgcaatcatcatgggtatgcctacctggaagaaatatacctgcggagttccatcaccgggttataggaaatttcttggccatatgctcaaatgcataccgatttaagctttgtgccgtggtttcccctaaacaggtgatggtggaagatgaagatatagaattactgtgtcacatactcataaatggttgccccatgaagagccccattaagagcatatataatcttaggattagaatccaatcagaacatctgtttatatttccctccacaatgctcaaggaagaccgacagcttggacaatacagtgagatattgttcaaatttagcaccacatctcagaacactgaaattattaaatgtggtgtccaaatcttgagggacagaagaagctgtgattctaagtcagaacaagacgacgatgaaagtctctacagcagccttgactatgatgcaccaagagtagataccattaacttactaaaggaacataaagacttgataagtgattatttcacatcattcttttccttgtggtgtttggatgagcttttgggaattctgaaatgcaaggaagagatggggcagatagtgatgaccatcttctatggagtagatccttctgatgttcggaaacaaaccggagatttcgggaaagtcttcaaggaaacatgccgtcgcaaaacagaggaagagaggcgaagatggagccaagctttgaccgatgtgggaaacattgccggggaacactttctcaactgggacaaggaatcggagatgattgaaaagattgctagagatgtctcaaacaaacttaatgctaccatctctagggactttgaagacatggttggtattgaagcacacttggatgagatgaactctttgttacatttagatgatgaggatggagctatgtttgttggaatctgtggccctgcaggcattggcaagactaccattgctagggctttacatagccgactctccagcactttccagcatacctgttttatggagaaccttagaggaagctgtaacagtggtactgacgagtatggattgaagttgcgtttacaagagctacttctttccaagatttttaaccaaaatggtgtaaaactatttcatttaggtgccataaaggaaaggttatgcgacctaaaagttcttatcgttcttgatgatgtggacgatctgcagcagcttgaggctttggctgacgatactaactggtttggtgatggaagcaggattatcgtaaccacggaagatcaagagattttggagcaacatggtatcagcaatacataccgtgtggatttcccaactcaagtagatgctcgtcagatcttttgtagatttgcttttagacagctctctgcaccccatggttttgaaaaacttgttgacagagtaataaagctttgcagcaaccttcctttgggtctccgtgtcatgggctcgtctttacgcagaaagaaagtagacgactgggaaggtatactgcagagactagagaatagctttgatcaaaagattgatgcagtacttagagtcggatataacagtttgcataaggatgaccagttcctgtttctcctcattgcatgcttcttcaactacaaagacgatgatcacgtgaaagcaatgctcgttgatagtaacttggatgttagactcggcttgaaaaatctcgtgtataaatctctcatacagatatccgcagaaggaaccatagtaatgcacaagttattacaacaagtgggtagagaagcggttcatttgcaagatcctaggaaacgccaaatcctaatagattctcaccagatttgtgatgtcctcgaaaatgattctgatggtacaagtgtgatgggtatatcctttgatacatccacaatcccaaacggagtgtatataagcgcgcaagggtttagacgaatgcgtgatcttcggtttctcagcatctacgagacaagacgtgatcctaatgttagagtgcatttacctgaggacatgagttttccacctcttctaaggttattacactgggaggtatatccaggaaagtgtcttcctcatactcttaggcccgaacatcttgtggaactctgttttgttaacagcatgctcgagcagctttggcaaggagtccagcctcttacaaatctcaagaagatggacttgtccgggtcactgagtttgaaggaagtccctgatctttcaaatgctacaagtctcaagagattaaatctaacaggttgctggagtttggtagagattccttcctctattggagaccttcataaactggaggagctggagatgaatttatgtgtaagtgtacaggtttttccgactctactcaacttggcatctcttgaatcactcaggatggtaggatgctggcaactaagcaaaattcctgatcttccaaccaacatcaaatcacttgtagtcggggaaacaatgctacaagagtttcctgaatcagtcaggctttggtctcaccttcatagtctcaacatatatggcagtgtcctcacagtgccacttttggaaaccacgtcgcaagaattctccctcgctgctgctacgattgagaggattccagattggatcaaagattttaatgggctaaggtttctttacatagctggctgcacgaaacttggatcactgccagagctccctccctcgcttagaaaactaatagtagacaactgtgagtcactagagacggtctgttttccttgcgacactccaacaactgattatctctacttccccaactgcttcatgttgtgccaagaagcaaagagagtaatcacacagcaatcattgagagcttacttcccaggaaaagagatgcctgctgcagagttcgatgatcatcgatcatttggaagttccttgaccatcatccgtccggctatctgcaagtttaggatttgcctggtgctttctcctgcaccggatatggaagaagcttatttcaaattactgtttcgcatacgtgcaaaaggttgtcccagtgatgatgacatgctttcgttagatctcgctaaaatccaaggggagcatctttttatatttcacattgagtttgttgaacatcacgaggagatggtgttcaaattcagcacctcatcccacgaagtcgacgttattgaatgcggtgtacaggtcttgacagatgaaaccagcagaagaagcaatgaatcttgttcagaacaagtgtctgaagacggggatgatattctatcggatgatgataagagcaatgagatttatgaacccagagtaaagatatttacgggttatacaatgtttctttctttagtttttacgttccttttgagtttgatttcaagtctaattctgtatagattcctaaagaactaa

SEQ ID NO: 61 - protein, 886 aa, Raphanus sativum
MDAPKEIFLKDYTKPDYYFETVDLSFSLGEEKTIVSSKIKVSPRVKGSSAPLVLNGHDLKLLSVKVEGKLLKGLYKSSGNFCTQCEAEGFRKITFYQDRPDIMAKYTCRVEADKSLYPVLLSNGNLISQGDVEGGRHFALWEDPFKKPCYLFALVAGQLASRDDTFTTRSGREVSLKIWTPAEDLPKTAHAMYSLKAAMKWDEDVFGLEYDLDLFNIVAVPDFNMGAMENKSLNIFNSKLVLASPETATDADYAAILGVIGHEYFHNWTGNRVTCRDWFQLSLKEGLTVFRDQEFSSDMGSRTVKRIADVSKLRIYQFPQVTTWVYLVFSKPILCCLIIQDAGPMAHPVRPHSYIKVYEKGIDLYFQRHDEQAVTCEDFFAAMRDANNADFANFLQWYSQAGTPVVKVASSYNAEARTFSLKFSQEIPPTPGQPTKEPTFIPVVVGLLDSSGKDITLSSVYHNGTLQTISSSSTILRVTKKEEEFVFSDISEKPVPSLFRGFSAPVRVETDLSDDDLFFLLAHDSDEFNRWEAGQVLARKLMLNLVSDFQQNKPLVLNPKFIQGLGSVLSDSSLDKEFIAKAITLPGEGEIMDMMAVADPDAVHAVRKFVRKQLASELKTELLKIVENNRSTEAYVFDHPNMARRALKNTALGWHLRVIIKLNESLFVRKSLTSLCVCFVEIMPAYLASLEDPAYVELALGEYKSATNLTDQIAALAALAQKPGQTRDEVLADFYNKWQGDYLVVNKWFLLQASSDIPGNVENVKKLLDHPAFDLRNPNKASEFSKLLFVPQLSFSDVYSLIGGFCGSPVNFHAKDGSGYKFLGDIVVQLDKINPQVASRMVSAFSRWKRYDETRQALAKAQLEMIMSANGLSENVFEIASKSLAA

SEQ ID NO: 62 - DNA, 2661 bp, Raphanus sativum
atggatgcacctaaggaaatctttctcaaggactacaccaagcctgattactactttgaaactgtggatctaagcttctctctaggtgaagagaagacaattgttagctccaagatcaaagtttcccctcgagttaaaggatcttctgctcccttggtcttgaatgggcatgacttgaagctactctctgtcaaggttgaggggaagcttctaaaggggctctacaagtcatctgggaatttttgcacacaatgtgaagcagagggtttccggaaaatcacattttaccaggaccgtcctgatattatggcgaagtacacatgccgtgttgaagctgacaagtcactctatcctgtactgttgtccaacggaaacctcatttctcaaggagatgtagagggaggtcggcactttgccttatgggaggatcctttcaagaagccatgctatctatttgctctggtggctggacagctagcgagcagagatgatacatttactacacgctctggtagggaggtatctctgaaaatctggactcctgcagaagatctaccaaagactgctcatgccatgtattctctgaaggcggccatgaagtgggatgaagatgtgtttggccttgagtatgacctggatctcttcaacattgtcgccgttccagattttaacatgggagccatggaaaacaagagtttgaacatttttaattccaagcttgtcctggcatctccagaaactgcaacagatgcagattatgctgcaattttgggagttattggtcatgaatacttccacaattggacaggcaacagggtgacatgccgtgactggttccaactcagtctaaaggaaggtctaactgtcttccgtgatcaggagttttcatctgatatgggaagccgtactgtaaagcgtattgctgatgtttcaaagctcaggatctatcaattcccgcaggtcactacatgggtttatctcgttttttctaagccaatcctctgttgtttaattatccaggatgctggtcctatggcacatcctgttcgcccacattcatacatcaaggtttatgaaaagggtattgatctttattttcaaagacatgatgagcaagctgtgacctgtgaagacttctttgctgctatgcgtgatgcaaacaatgcagattttgctaatttcttgcaatggtactctcaagctggaacgccagtcgtcaaagtggcatcctcttacaatgctgaagctcgtaccttctctttgaaattcagtcaggagatacccccgactccgggccagccaacaaaagaaccaacatttattccagtggttgttggtcttctggactcaagtggaaaagacattacactttcctctgtttaccataatggtacacttcagaccatttcaagcagcagcacaatccttcgagtgaccaagaaagaagaagagtttgtgttctctgatatatcagaaaaacctgtgccgtctctgtttagaggattcagtgccccagttcgtgttgagactgatctctctgatgatgatctgttcttcctcttagcccatgattcagatgaattcaatcggtgggaggcaggtcaagttctggcaaggaagctcatgctgaacttagtttctgatttccaacaaaacaaaccattggttctaaacccaaagttcattcagggtctcggcagcgtgctttctgactcgagcttggacaaggaatttatagccaaggcaataacattacctggggagggagagattatggacatgatggccgtggcggatcctgatgctgttcatgccgttagaaagtttgttagaaagcagcttgcatctgaacttaaaactgagcttctaaagatagttgagaacaataggagcactgaggcttatgtctttgaccaccccaatatggctaggcgtgctttgaagaacactgctctaggttggcatttgcgagtcattattaagttaaacgagtctctctttgtgcggaagtcactaacttctttgtgtgtttgctttgttgaaataatgccagcttatcttgcatcgcttgaggatccagcatacgtggaacttgcattgggtgaatacaagtcggccaccaatttgacagaccaaattgctgctttggcagctcttgcacaaaagccgggtcaaacccgtgatgaggttcttgctgatttctataacaagtggcagggcgattacttggttgttaataaatggttcctccttcaagcatcatccgacattcccgggaatgtggagaatgtcaagaagcttttggatcacccagcttttgatctgcgcaatccaaacaaggcaagtgaattctcaaaactcttattcgttccgcaactttctttctcagatgtttactcgctcattggagggttctgcggttcgccagtgaatttccatgcaaaagatggatcaggttacaagttcttgggtgacattgttgtccagttagacaaaatcaatcctcaggttgcttctcgtatggtatctgcgttttcgaggtggaagcgctacgatgaaacccgacaagctctggccaaggcacagttggagatgataatgtcagctaatgggttatctgaaaatgtatttgagattgcctctaagagcttggctgcttga

SEQ ID NO: 63 - protein, 403 aa, Raphanus sativum
MRGLVKKLVSRSLSVSGKWQHQQLRRLNIHEYQGAELMGKYGVNVPNGVAVSSLDEVKNAIQQVFPNETELVVKSQILAGGRGLGTFKSGLQGGVHIVKRDQVQDIAGKMLGQVLVTKQTGPQGKVVSKVYLCEKLSLVNEMYFSIILDRKSAGPLIIACKKGGTSIEDLAEKFPDMIIKVPIDVFAGITDEDAAKVVDGLAPKAADRKDSIEQVKKLYELFRKSDCTMLEINPLAETSTNQLVAADAKLNFDDNAAFRQKEIFALRDPTQEDPREVAAAKVDLNYIGLDGEIGCMVNGAGLAMQPWTSLNCTVVEAFKILTSDDKVKAILVNIFGGIMKCDVIASGIVNAAKEVSLKVPVVVRLEGTNVEQGKRILKESGMKLITADDLDDAAEKAVKALAN

SEQ ID NO: 64 - DNA, 1212 bp, Raphanus sativum
atgaggggattggtgaagaagctcgtgtccagatctctctccgtctccggcaaatggcagcaccaacagcttcgccgtctcaacatccacgagtatcagggagcagagctgatgggtaaatacggagtaaacgtgcccaacggagtcgctgtctcttccctcgatgaagtcaaaaacgctatccaacaagttttccctaatgaaaccgagttggtcgttaagagccagatcttggctggtggaagaggtctcgggactttcaagagtggtcttcaaggtggtgttcacattgtcaaacgtgatcaggttcaagatattgctggcaagatgcttgggcaagttctcgtcaccaaacaaactggtcctcaaggcaaagtagtcagcaaggtctacttgtgtgagaagttgtcactcgtcaatgagatgtacttttccattattctcgaccgtaaatctgctggaccgcttataattgcctgtaaaaagggtggtaccagcattgaagatcttgctgagaagttccctgacatgattattaaggtaccgatcgatgtatttgcaggtattacagatgaggatgctgccaaggttgtggatggtctggctccaaaagctgctgacagaaaagattcgattgaacaagtgaagaagctttacgaactcttccgcaagagtgactgcactatgttggaaatcaaccctctcgctgagacatccacgaaccaattggtagctgctgatgctaagttgaactttgatgataatgctgctttccgtcagaaagagatttttgcccttcgtgatccaacgcaggaggatccacgagaggtggctgctgcaaaagtggacctgaactatatcggtttagatggagagattggctgcatggtgaatggtgctggattggccatgcaaccatggacatcattaaactgcacggtggtggaggcgtttaagatactgacatcggacgataaagtgaaagcaatattggtgaacatattcggtgggataatgaaatgtgatgtgattgctagtggaattgtgaatgctgctaaagaggtgtcactgaaagtaccagtggtggttcgtctggaaggaacaaatgttgaacaaggaaagagaatcctcaaggaaagtggaatgaaactcataacagctgatgatttggatgacgcagcagagaaagctgtgaaggcattagctaattag

SEQ ID NO: 65 - protein, 86 aa, Raphanus sativum
MEVFRNHKKLIFTKPESFEKIAPKLKFLGLLAARIETECEGASEIGLTRGLRRWIRFVESCDLIYYASSGSLRFERTNCLKSSDEF

SEQ ID NO: 66 - DNA, 261 bp, Raphanus sativum
atggaagttttcagaaaccataaaaagttaattttcacaaaaccggaaagttttgaaaaaattgcgccaaaattaaagtttttagggttactggcggcgcgtattgaaacagagtgtgagggagcgtccgagatcggattgacacgaggtttacggcgttggattcgtttcgtcgagagctgcgatttgatatattacgcgtcgtctggatccttacggtttgagagaacaaactgtttgaagtcgtcggatgagttttag

SEQ ID NO: 67 - protein, 134 aa, Raphanus sativum
MNTAIVLKIRGLDRCIIKGEYAAENEKYGAITIIRQHLTEDLRDQYLNIANPLDLRTELKSRYTIVSLPKFITQMGLLFEWINLRFRDFRSVDEYNSALIKIVSKLKLCGEEHCLRQNERSHETSSRESDQKNV

SEQ ID NO: 68 - DNA, 405 bp, Raphanus sativum
atgaacactgcaattgtcctgaagataagaggacttgacagatgtatcatcaaaggcgagtatgcagctgaaaatgaaaaatatggggcaataacaattattcgccaacatctcactgaggatctcagagatcagtatctaaatattgcgaaccctctagaccttcggacagagttaaaatccagatacacaatagtgtcattaccaaaatttataactcaaatgggtcttttatttgagtggataaatctcagatttcgggactttaggtccgtagatgaatataactcagctctaatcaaaatcgtttctaaattgaaactatgtggtgaagagcattgtctacgacaaaatgaaagaagtcatgagacatcatccagagaaagtgaccagaagaatgtctga

SEQ ID NO: 69 - protein, 85 aa, Raphanus sativum
MIHQPVPKLLPKKFIVSFALNRVIPLLHLWTMHSYLVDELLVILCNFAGFLELHLDMVKTCSFDADHSTMSSCSGRMDDAQSVLG

SEQ ID NO: 70 - DNA, 258 bp, Raphanus sativum
atgattcatcaaccagtgccgaagctcttacccaagaagttcatagtttcgttcgctctcaatcgagtgattccacttctgcatctttggacgatgcattcctatctggtcgatgagcttcttgtaatactttgtaatttcgccggctttctggaacttcatttggacatggtcaagacgtgctcctttgatgctgaccactcgacaatgtcttcatgttctggtcggatggatgatgctcaatcagtactcggatag

SEQ ID NO: 71 - protein, 278 aa, Raphanus sativum
MFARNIRLRKEYLYMKNLEGEERRLYEKKRKIREALQEGKPIPSELRNEEAKLREEIDLEDQNTSVVPGSHIDDEYAKATEKDPKILMTTSRDPSAPLTRFVKVISEIIEMARSHDYSDVIFVTENRGRPDGLIVSHLPFGPTAYFQLLNVVTRYDIQSKKATGKMSEQYPYVIFDNFTSQMGKRVGSMLKHMFPVPKLDARRIVTFRNKSDYISFRNHVYDKGEGGPKSIELKEVGPRFELRLYQVKLGTMEQEEAEMEWVLRPYMNSAKKRRFIGQ

SEQ ID NO: 72 - DNA, 837 bp, Raphanus sativum
atgtttgccaggaacattaggttaagaaaggagtatctctacatgaaaaacttggaaggtgaagagcgtcggctctatgagaagaagcggaagataagggaagccctgcaagaagggaagccgattccatctgagctccgaaacgaggaggcgaagcttcgtgaggagattgatcttgaagatcaaaacacctccgtagttccagggagtcatattgatgatgaatatgcaaaagcaacggaaaaagatcccaagattttgatgactacgtctagggatccaagtgctcctctaacgcgattcgttaaggtcatttctgagattattgagatggcgcgttcgcatgattatagtgatgtgatatttgttactgagaaccgtggtaggcctgatggccttatcgtttctcatctcccattcggaccaactgcttactttcaattacttaatgtggtaacaaggtatgatatccaaagcaagaaagcaacggggaagatgtctgagcaatatccttacgtcatttttgacaactttacaagccagatgggtaaaagagttgggagcatgttaaaacacatgttcccagttccaaaactggatgcaagacgtatagttactttccgtaataaatctgattatatttctttcaggaatcatgtgtatgataaaggagaaggaggcccaaaatcgatagagttaaaagaagtcggtcctcggtttgagttgcggctctaccaggtgaaattaggaacaatggaacaagaggaagcagagatggaatgggttcttagaccctacatgaactctgctaaaaaacgccgctttatcggccaataa

SEQ ID NO: 73 - protein, 222 aa, Raphanus sativum
MAAITSLQAIHLKLGRRGSIRCGISEPSGEPAPVGQKTRYNDGLAERVFMGLFARKMDKFGGSKKKKKDETKEKEFWEYDYESFVEVSKGVMQGRSRAQQQEVVREVLLSMLPPGAPEQFRKLFPPTKWAAEFNAALTVPFFHWLVGPSQVIEVEVNGVKQRSGVRIKKCSTCLFTVVDFEDMSCEMIYGQVPPTFEEDPATKQPCLADICSYTSKPNPPEP

SEQ ID NO: 74 - DNA, 669 bp, Raphanus sativum
atggcggctattactagtctccaagcaatccatctcaaactcgggagacgtggcagcatccgatgtgggatctcggagccgagcggagagccagctccggtagggcagaagactagatacaacgatggcttagctgagagagtgttcatggggctgttcgcgaggaagatggacaagtttggtggctcgaagaagaagaagaaggatgagacgaaggagaaagagttttgggaatacgactacgagagcttcgtcgaggtttcaaagggagtgatgcaaggacgatcaagggcacagcagcaagaggttgtgagagaggttcttctctccatgctccctcccggcgctcctgaacagtttagaaagctcttcccaccgacgaaatgggctgcggagttcaatgcagctcttacggtgcctttctttcactggctggttggtccttctcaggtcatagaagtggaagtgaatggtgtgaaacagagaagtggggttcgtataaagaaatgcagtacttgcctatttactgttgtagattttgaagatatgagttgcgagatgatatacggacaagtgcctcctacatttgaagaagatccagccacaaaacaaccttgtttagcagacatatgttcttacacatccaaaccaaatccaccagaaccttaa

SEQ ID NO: 75 - protein, 214 aa, Raphanus sativum
MDNVIAKKFTAMFNHRRLNLSRSSLFTASAASVISLIVFTIFIVSHVLVRDFTEVVTIEIKTVVPYLPLRSEREQSNYTFTVKKDNNLHVLDVFGGRDVSGKFQQRVTEFLREDCEVYFMMTWISPAVMFERFMRAITFQFETLSSSKSGVIQNLKGSDQIKILTNSETISLPVNDPRKIIHNTKPRDSRAVGNLYRNNVKEEMYASDFCCCQV

SEQ ID NO: 76 - DNA, 645 bp, Raphanus sativum
atggataacgtcatcgccaagaaattcacggcgatgttcaatcaccggcggttaaacctctcacgatcatcactcttcacagcatctgcagcctcagtcatatctctcatcgttttcacgatcttcatcgtctctcatgtactggttagagacttcacagaggttgtgacgatagagatcaagacagttgttccttacttacctctgaggtcagagagagagcaaagtaactatacgttcacagtcaagaaggataacaatcttcacgttctcgacgtttttggaggcagagacgtgtcggggaagtttcagcagagagtaacagagtttctgagagaagattgcgaagtctacttcatgatgacgtggatctctcccgcggttatgttcgagaggttcatgcgagccatcacatttcaattcgaaactctgtcgtcctcaaaaagcggagtaattcaaaatctgaaaggaagtgatcagatcaaaattcttacaaacagtgagactatttccttacctgtgaacgacccgaggaagataatacataatacaaaacctcgagattcccgagccgtagggaatttgtatcggaacaacgtaaaggaggagatgtacgcaagcgacttctgttgctgtcaagtatga

SEQ ID NO: 77 - protein, 184 aa, Raphanus sativum
MVSRNKFAHNFTEKSRFSDYGLYRSVAKFLEKAFLEQREKGEEENASLLQICRGTTQTESARRFYETLDVTSGFSVRFNFVGFIGFQVLETLLIDLRWALTCSRVCACMQTQHKLEMDKRDGVFGPQPMGVPPAQQMSRFDQPAPPVGYPPASYPPAQGYPPAPYPPAQGYPPASYPPPGYPQH

SEQ ID NO: 78 - DNA, 555 bp, Raphanus sativum
atggtcagcaggaacaagtttgcacataatttcacagaaaaatccagattttctgattatggattatacaggagtgtggcaaaattcctggagaaagcgtttctggagcaaagggagaaaggtgaagaagaaaatgcgagtttgttacagatttgcagaggaacaactcagacggaaagcgcaagacgcttctacgagactttggatgtcacatctggtttctctgtccggttcaactttgttggatttatcggttttcaagtattggaaactctcttaattgatttgagatgggcactaacgtgttctagggtctgcgcgtgtatgcagactcaacacaagcttgaaatggacaaaagagatggagtgtttggtcctcagccaatgggagttccaccggcacagcagatgtcccgttttgaccaacctgcccctccagtcggctaccctcctgcgtcttacccaccggctcaaggctaccctcctgcaccttacccaccggctcaaggctaccctcctgcatcttatccgcctcctggttatccccaacattga

SEQ ID NO: 79 - protein, 688 aa, Raphanus sativum
MFNAWIHREYVDNEDDYCLLIHSPTISFYRPEQYKLTTEPKNYVFSFGEKLCFSVLMGNCVFDFDRKFGFSVLAEIAFFGFGGKLYFSILAGNYIFPVLRGFQPQDTDVIIASYPKSGTTWLKALTVALLERSKNHSSDHPLLYHNPHGIIPFLEIDVYHESSSPNLAKFSAPPRLFSTHMPLHTIHEALKHSPCKIVYVCRNVKDTLISCWFYSCAIYKIEPTRRVLESMFNEFCDGTNYFGPFWDHLLSYWRGSLEDPKHVLFMRYEEMKAEPRDQIKRLADFLGCPFTKQEEDSGSVDGILDLCSLRNLSSLEANKTGTINNVEHKFFFRKGEVGDSKNYLTSEMEKDRHDHQRKTSRFWFEFLEFLEFYYYVEQNICFTFGSGLLDFDPSEVRREIVFEFSSSSHDFDIIERGSFESKMHDFYGDDGGDSETSISVSVIENMKEEYGLFVWPCSVILAEYVWQERSRFRGSSVLELGAGTSLPGLVAAKVGANVTLTDDSSKTEVMGLTWGVWDATIFDLRPNIILGADVLYDSSGLIRKLISTLFWFIGLPDFLEPEPVTSSWPDPPPNSTTSSHHDSHLFSAALLAGQILPVVRFSDLNRPESECCAVCLYDFENDDEIRRLTNCRHIFHKECLDRWIMDYSQMTCPLCRTQFVPDELQTDFSQKLWSESSEDVSELLAQSS

SEQ ID NO: 80 - DNA, 2067 bp, Raphanus sativum
atgttcaacgcttggattcatcgagagtatgtcgataacgaggacgattattgcttactgatacatagcccaactatcagtttttacaggcccgaacaatacaaattaacaactgagcccaaaaattacgtttttagttttggcgagaaattatgtttctcggtattgatgggaaattgcgtttttgattttgacaggaaattcggtttttcggttttggcagaaattgcatttttcggttttggtggaaaattgtatttttcgatcttggcaggaaattacatttttccggttttgagaggttttcaaccgcaagacactgatgtaatcattgcttcgtaccccaaatcaggcactacttggctcaaggccctcacagtcgctctgcttgagagatcaaagaaccactcttctgatcatcctctcctatatcataatcctcatggcattataccattcttggagatcgatgtgtaccacgaaagctcaagtcctaacctagccaagttctcagcacctccgaggctgttctcgactcacatgccactgcacacgatccacgaagcactcaagcactctccttgcaagattgtgtacgtgtgcaggaacgtgaaggacacgttgatctcgtgttggttttacagctgtgctatatataaaatcgaaccaaccagaagagttctcgagtctatgtttaacgagttctgcgatggaaccaactattttggacctttttgggatcatctcttgagttactggagaggaagcttggaagacccaaagcatgtccttttcatgaggtatgaggagatgaaagccgagcctcgtgatcagatcaagagacttgcggacttcttgggatgtccttttactaagcaagaagaagatagtggatctgtggacgggatcttggacctctgctctctgcgtaatctgagcagtttggaggctaacaaaacagggacaataaacaatgtggagcacaagttttttttccgtaaaggagaagtcggtgactcgaaaaattatcttacgtctgaaatggagaaagatagacatgatcatcaaagaaaaacttcaaggttctggtttgagtttttagagtttttagagttttattattatgtcgaacagaacatttgttttacatttggctctggcttgctagattttgacccatcagaagtgagaagagagatagtgttcgaattcagcagcagttcccacgacttcgacattattgagcgtgggagctttgaatctaagatgcatgatttctatggcgatgatggaggagattccgaaacttccatctctgtatctgttatcgagaatatgaaggaagagtatggtttgttcgtttggccttgtagcgtcatcctcgccgagtacgtctggcaagagcgatctcgatttcgtggctcttcagttctcgagctaggagctggcacttctttacccggtttagtagctgctaaggttggagctaatgtcacccttaccgatgactcaagcaaaacagaggtaatgggtctcacttggggagtgtgggatgcaaccatatttgatctgcggcctaacattatacttggagcagatgttctatatgattcaagtggtttgatacgaaaactaatctccacacttttctggttcattggtttacccgatttcttggaacccgaaccggttacatcttcatggcccgacccaccaccaaactccaccacctcaagccaccatgactctcacttgttttcagcagcgctgctagctggacagatcttgcccgttgtcagattctcggatctaaaccgacccgaatccgaatgttgtgcagtgtgtctctacgacttcgagaacgacgatgagatccgacggctgacgaattgcaggcatattttccataaagaatgcttggaccgttggattatggattatagtcagatgacgtgtccgctttgtcgtacccagtttgtacctgatgagcttcaaacggactttagtcaaaagctttggtcggaatctagtgaagacgtttctgaacttcttgctcaatcatcttag

SEQ ID NO: 81 - protein, 1323 aa, Raphanus sativum
MSKQIDELRSSQNQQTEELGSKINALEALIEKYFANAPPPQRDGKQTDASSDITDGTPQAKAPPDRSNPENSSFKPHDNNNPPIHHSLSARLTKIGFPMFDGSELREWTYGCEQFFSIDSTPPELKVRLASLHMTGKALQWHHSYLANRYNIFSLWPEYVAAISDRFSELYDDPLAELVSLKQGNDTIDVYLDKFDCAMTRITLAPDHALSIFLTNMNQHLALHVRQFKVSTVPEAAKIAKLHELSLSHMPTKTSRPPFNSSQRSNYSQPNKSQNHNSTSPTTTANPNNKPLIANAPQKWLSFDEMQERKRKGLCMFCEEPFTPGHHLKHKRAEFLFLDLDAETEFDDEIALVEQIRETTISDDDDKVPTISVHALNGAPTFNCMRLVRKYEKRKLHILIDPGSTHNFLDIQMAKGLGCSLTPIKPMSVVAASGDLVTKYKCSSFAWKMQGYGFTAEIRTLPLGCSDLVLGVQWLSTLGPILWDFLNLRMEFKFNELKHVLRGISPNSSKLISGSSFNKLMLQDPQLALLHLREIDETTEQEPLEPETIFCHIEASETENDNSGSLERLLDSYTDVFDEPSTLPPYRAGFNHKIPLEAGSNPVNLRPYRYSSIQKDSIDKMIQDMLSQGIIQYSASPYASPIVLVKKKDGSWRLCVDYRGLNKQTIKDKYPIPLLEDLLDELGGSKYFSKLDLRAGFHQLCMSPEDVHKTAFKTHSGHYEYLVMPFGLTNAPCTFQGLMNHVFAPVLRKFLLVFFDDILIYSKTWEEHLDHLDKVLAILRHQQLYLKKSKCTFGGTRIEYLGHFISHDGVSTDPTKIKAVEEWPQPKHQKHLRSFLGLANYYRRFIQGYSIIARPLTIMLRKDGFAWNTEASDAFHLLKQALISAPVLALPDFSKTFIVETDASNTGIGAILMQDNHPVCYISRALGPRHQGLSVYEKELLAVVHAIITDLQNKPGSHAAYSFVNGELRRRGKLVVGNDPAIKLHIFKWLHDSAPLPVPTGVWESVSLDFIEGLPPSSGKHCILVVIDRLSKNAHFLALSHPYTAMDVAKLYMDQVFRLHGMPKDITSDRDPTFLSEVTNKTLETYLRCMTSDSPSTWSAWLPLAEWWYNTTYHTAIRSSPFEIIYGQPPPVHLPYLPGESTSTTVDRSLQRREELIDMMKFHLLRAQNRMKQYADSHRSERAFHIGDYVYLKLQPYRQHSLKGRHLPHKLSPRFYGPYEIQDRVGNLAYKLRLPFEAAIHNVFHVSQLKLGPNPPATPSSLPQYLKDVGTAKEPEKILETKMVNRRNRAVTKVLVQWKGYSPEQATWEFYQDFVAKHPDFNT

SEQ ID NO: 82 - DNA, 3972 bp, Raphanus sativum
atgagcaagcaaatagacgagctacgttcttcgcaaaaccagcaaactgaagaactcggtagcaaaatcaacgcactcgaagcactcatcgaaaagtacttcgctaacgctccacccccgcaacgcgacggtaaacaaacagacgcaagttctgatattacggatggaacaccgcaagctaaggctccaccagaccgttccaatccagagaacagttcctttaaacctcacgacaacaataacccacccatccatcatagcctatccgcaaggctaacaaagattggctttccaatgtttgacggctccgaactacgagaatggacctacggctgtgaacagttcttctccatcgacagcaccccaccggaattgaaggttcgtcttgcatctcttcatatgacgggaaaagcactacaatggcatcactcttaccttgccaatcgatacaacatcttttcattatggccagaatatgttgctgcgatctccgatcgtttcagtgagctttacgacgatccattagcagagttggtaagcttgaaacaaggaaacgataccatcgatgtgtatctagataaatttgattgcgccatgaccagaatcacgcttgcgccggatcacgcattgagtatattcttgacaaacatgaatcaacatctagctcttcacgtgcgccaattcaaggtcagtacagtacctgaagccgcaaagatagccaaactacacgagctctccctctcacatatgccaacaaagacatcgcgccccccattcaactcttctcaacgatcaaactactcccaacccaataaaagccaaaaccacaactccacctcccctactactaccgccaatccaaacaacaaacccctcattgcgaatgctcctcaaaaatggctttcttttgacgagatgcaggagcgcaaacgtaaaggattatgcatgttctgtgaagaaccgtttacaccaggtcaccaccttaagcataagcgcgctgaatttttgttcttggacttagacgctgagacagaatttgacgacgagattgcactagtggagcaaatccgtgagacaaccataagcgacgatgatgacaaagttccaactatctccgtccacgccctcaacggtgcgccaactttcaactgtatgcgcctcgtcaggaaatacgagaaacgtaaactacatatactgattgatccagggagcacacacaacttcttggacatccagatggctaagggattaggttgttctttgacaccaatcaaaccaatgtcagttgttgcagcaagtggcgacttggttactaagtacaagtgcagctcttttgcttggaagatgcaaggctacgggttcacagctgagattcgaaccttaccactaggatgcagtgatctcgtcctgggggttcaatggctttccaccttaggaccaatcctatgggatttcctaaaccttcgtatggagttcaaattcaacgagctaaaacatgtcttacgtggaatatcacccaacagctcaaaattaatttctggaagcagctttaacaaactgatgttgcaagatccacagcttgctctactccatcttcgcgagattgacgaaactacagagcaagaaccccttgaaccggaaacaattttctgtcatattgaagcgagtgaaacagagaacgacaattccggttcactcgagagactccttgattcatacacggacgtatttgatgagccgtcgaccttacctccttatcgcgcgggtttcaatcacaaaataccattggaagcaggatcaaatcctgtgaatctccgaccatatcgatactcttcgatacaaaaggattcaatagacaagatgattcaagacatgctttctcaaggtatcattcagtacagtgcaagtccctacgcttcacctattgtacttgtgaaaaagaaagacgggtcttggcggctttgtgtcgactacagaggtctcaataagcaaacgatcaaagacaaataccccatcccactactcgaagatctccttgatgaattgggcggctcaaagtacttctctaaactggatttacgtgcaggtttccaccagctttgtatgtctccagaagatgtgcacaagacagcttttaaaacacattcaggccactacgaatatttggtaatgccattcggcctcacaaacgcaccttgcacgtttcaggggcttatgaatcacgtattcgcacccgttctacgaaagtttctccttgttttcttcgacgatatattaatctacagcaagacctgggaggagcacctggatcacttggacaaggttcttgctatacttcgccatcaacaactctatctcaagaaatcaaagtgtacttttggaggaacgagaatcgaataccttggtcactttatttcccatgatggcgttagtactgacccaaccaagataaaggcagtcgaggaatggccacaaccgaagcaccagaaacacctccgcagcttcttaggtctagccaattactatcgaagattcatacaagggtacagcattatcgctcgaccccttaccatcatgcttcgcaaagacggttttgcttggaatacagaggcttcagacgcgttccatctcctcaaacaagcattaatctcggccccggtccttgcactccccgatttctccaagactttcatcgtcgaaaccgacgcttccaacactggcataggcgcaattcttatgcaggacaatcacccagtgtgctacataagtcgtgcattagggcctcgacaccaaggcctttctgtttacgagaaggaactccttgctgtggtccacgcaatcattaccgacctgcaaaacaaacctgggtctcacgccgcgtactcctttgtcaacggagaacttcgccgccggggtaaacttgtggttggtaacgaccctgctatcaaacttcatatcttcaagtggcttcatgattctgctccgttaccggttcctacgggtgtatgggagtctgtgagccttgactttatcgagggtctaccaccatcatcaggaaaacattgcattctcgtcgttattgatcgtttaagcaagaatgctcactttctcgccttgtctcatccgtacactgcaatggacgtggcaaagctatatatggatcaggtctttcgtcttcatgggatgcctaaagacattacaagcgatcgtgacccaacgtttctcagcgaggttactaacaaaactttggaaacctatctccgatgcatgacttctgattcaccttctacatggagcgcgtggttacccttagcagaatggtggtataatactacttaccacactgcgattcgcagttcaccgttcgagatcatctatggccagccacctccagtgcacttgccttaccttcccggcgaaagtacttctaccacggttgacaggtccttacaacgaagggaagagctcattgacatgatgaagttccacctcttgcgagctcagaacaggatgaaacaatacgcagactcgcaccgttctgaacgtgcgtttcatattggtgactatgtctatttgaagctccagccgtatcgacaacattccctcaaaggacgacatttgcctcacaagctttcaccacgtttttatggtccgtacgagatacaagatcgtgttggtaacttggcatataagctacgtcttccatttgaagcagctatccataatgtcttccatgttagtcagctaaagctcggccccaacccgcctgcaactccttcgtcgcttccccaatacctcaaagatgtcggcactgcaaaggaaccagaaaagattcttgaaacaaaaatggtgaatcgccgaaacagagctgtcacgaaggtactagtacagtggaaaggctactctccggaacaagccacatgggagttctatcaagacttcgtcgcgaaacatcctgatttcaatacttga

SEQ ID NO: 83 - protein, 332 aa, Raphanus sativum
MIHWGGVTCCLSAAALYLLGRSSGRDAEVLKTVTRVNQLKELAQLLELDSSKLLPFIVAVSGRVGSDTPIKCEHSGIRGVIVEETDDGTSRVNVVGARGATGFALTVGSEVFEESGRSLVRGTLDYLQGLKMLGVKRIERVLPTGMPLTIVGEAVKDDIGDLRIQKPERGPFYVSPKSLDQLISNLGKWSRLYKYASMGLTVFGVFLITKHVIDFLLERRQRREIQKRVLDAAAKRAGTEGSNGAHESVSDSTKNEGAVPDLCVICLEQNYNAVFVPCPLCRRRIDQVIKLDIGHIDPSITSKGGRLELRTSETNLVDPDSETEIISMTDRS

SEQ ID NO: 84 - DNA, 999 bp, Raphanus sativum
atgattcattggggtggagtaacctgctgcctcagcgccgccgctctttatcttctcggccggagtagtggcagggacgctgaagtactcaaaaccgtcactagggttaaccaactcaaggagctagcgcaattgctagaattagatagcagcaagctccttcctttcatcgtagccgtttcaggaagagttggctctgacactcctatcaagtgcgagcatagtggcatacgcggcgttatcgtcgaggaaacggacgatgggacaagtcgtgtgaatgtagtgggagctcgtggtgcaacaggttttgctttgaccgtcggaagtgaagtttttgaagagtcagggcggtctcttgtacggggaacacttgattatctccaaggccttaagatgcttggagttaagcgcattgagcgtgttcttcctactggaatgcctctcacaattgttggtgaggctgtcaaggacgatattggggacctaaggattcagaaacctgaaagagggcctttctacgtctctcctaaatcactcgatcagctcatttctaatctggggaaatggtcaaggttgtacaagtatgcctccatgggtttaactgttttcggtgtgtttctaattacaaagcatgtcattgattttcttctagagagaagacagcggcgagaaatacagaaaagagtgcttgatgcagcagctaagagagctgggactgaaggttcaaacggcgcacatgagagcgtatcagattctaccaagaatgaaggcgctgttcctgatctctgtgtgatctgccttgagcagaactacaatgctgtgtttgtcccctgtccactttgtcggagacgtatagatcaggttatcaagttggatatcggccatatcgacccatcgatcacatctaagggcggtcggttagaacttagaacctcggaaaccaatctggtcgacccagattctgagacagagataatcagtatgacagatagatcctaa

SEQ ID NO: 85 - protein, 2437 aa, Raphanus sativum
MIAKIAKDVLQKLNATPCRDFEGIVGLDAHLKEIESLLDLDYDGVKMVAITGPAGIGKTTIARALHSLLSRRFQLTCFVDNLREICPSGLDEYGWKKRLQENFLSKVLNHKDMRICHLGAVKENLCDQKVLIILDDVNSLKQLEALANESAWFGPGSRIVVTTENLEILQQHGIGSTYHVGFPFDEEAIEILCRCAFRLRSPLYGFEVLCTRIIRLCGNLPLALCVVGKSLRGKKKDEWEDVVNRLETILDQGIEDVLKVGYESLEENEQTLFLHIAVFFNNEDSDLVKAMFSDGTIDVKRGLQILVYRSLIEISTYGNIIEMHKLLRRVGRQAIHKQEPWKRQILLDAHEICDVLENETGTRAVSGISFDISGINDLIVDERAFKRMYNLQFLKVYKSRDDKLKFDILAGEKSRDDMNDVIHIPEEMKFPRRLRFLHWNAYPNKCLPPSFHPEYLVELDMKHGKFEHLWKGTQRLANLKKLDLSFSCQLKELPDLSRATNLKILDMSYCKSLVEIPSSFMHLQKLELWWMDDCVNLQVIPDHLNLASLGIVEMNGCSKLRKFLFISTTSPRLSICGDSFRQRPPSSGMYSRIRKSGKLKGLTHLHKSLICLDLRYSDIETIPDCIKDLHQLEQLSLDGCRRLASLPELPGSIKSLNAEDCESLETVFCPLNSSPNAVLDFTNCFKLGQQARREIIHRSLSCEWVILPGKKVPAKFDHRARGSSLTIRIPYGNNPLSAVSILKLCVVVSPNHQISKKSRHSEYLVCRCISKGDLDPVVEEFCVSYVSRYRSEHLLIFHPRLPFIVPSEVSRETVFEFSSKSHEFDVIECGAKVFEDKSIQGSYESGSDQVSEDHIDYLTDGRYESCEDDINSLIDESLELNPANPLQATPYESSEEREWSEDEYELSEQYRQSRRQFRAQCRRRRSSIFEKSPFLGTETMVETRLQERSLTEQVDELRSLHDLLAAELKSRSDSLDARFDRLEALMFSANASPLHATGKAPLDPGPSHPPTPFNLGSSQPPDPPDLNGFRQHNEFGRLTSRLSKISFPKFDGTDLRDWLSKCEQFFDIDGTSQELKVRLAAMHLTGRATQWHTNYMSTRFGMFPSWTDYIIAISARFCELFDDPLAELVALKQGSDLVAAYLDKFETTRMRLVLPEAHALSIFLANMNPHLSLHTRQFETTSIAGAAKIAMLHESSLSHTPNRQRAPFNPYPNTKPYQKPNNPSPLLPLTQAPTNQKPSFIPRNPTDKPPRKFSYQEMQDRRSKGLCMFCDEPFTPGHQLKHKRSQIYVMECDDADTIPDDSSSDAEPESDDKQATVEVTPVISINALNGSTSYNCMRLIGHHGKHKLHILVDPGSTHNFVDLNIATQLGCELEPTRPMSVKAATGDTLLTNFKCSAFTWTVQGSSFTTEIRTVPLDCCDFVLGVQWLCTLGPILWDFLNLRMEFTLSGTKHVLRGVVKTGGKVIKGSSLNKLMLQEPQIALIQLQQIDENADNQQSLNPEMLYSHISASGTTNADDPALQQLLQTFEDIFQEPKSLPPFREGFDHQIPLLAGSNPVNLRPYRYSSLQKDTIDTMIKEMLTQGIIQHSASPYASPIVLVKKKDGTWRLCVDYRGLNKQTIKDKYLIPLLEDLLDELGGAKYFSKLDLRAGFHQLRMSEDDVYKTAFKTHQGHYEYLVMPFGLTNAPCTFQSLMNHVFQDLSRKSVLVFFDDILVYSKTWEEHLQHLAEVFLILQQQQLYLKLSKCTIGATIIEYLGHFISADGVSTDPRKIAVIRDWPIPTTQKHLRSFLGLANYYRRFIKGYSSIARPLSTLLKKDGFTWSLEADQSFSDLKAALSSTPVLALPDFDQPFIVETDASNTGIGAVLMQGKHPICFISRSLGPRHQNLSVYEKELMALVHAVQTWHPYLAHRPFIINTDQRSLKYLMEQKITTPFQHMWLSKLMGYNFEIHYKQGKDNVVADALSRVSGSQLLNMVLSQAHTGFYDSLKLLWETDATLQKIICDLKSNSSSHPLFTYTNGELRRRGKLVVGNDKDIKLHIFKWLHDSAIGGHSGRDATLHRIRSLFYWPKLNVEVQNYIRNCSICQQNKYDMAAKPGLLQPLPIPDGIWESISLDFIEGLPPSQGKHCIMVVVDRMSKNAHFIPLSHPYTALTVAQAFLDNIFKLHGMPKDVISDRDPIFISEVWNELFRVQGVTLKRSTAYHPQTDGQTEVTNKTLETYLRCMAAETPTSWSKWLSLAEWWYNTTFHSAIQATPYEVIYGQPPPLHLPYLPGESSSVVVDRSLQKREEVINMLKFHLLRAQNRMRQYADAKRSQREFKIGDYVYLKLQPYRQHTVKKNKAPHKLSPRFYGPFRVLDRIGKVAYKLSLPTEAAIHDTFHYWLDLGNTKEPAAILETKTVKRQNEAATKVLVHWKDESPEMATWEFYKDFTNKYPLFNP

SEQ ID NO: 86 - DNA, 7314 bp, Raphanus sativum
atgattgcgaagattgcaaaagatgttttacaaaaactgaatgcaacaccgtgtagagattttgaaggcattgtgggacttgatgctcatctaaaggaaatagagtctttgttagatctggattacgatggagttaagatggttgccatcactggtcctgcagggatcggtaagactaccatagctcgagctttacatagtctactctcccgtaggttccagcttacttgttttgtggacaaccttagggaaatctgtcctagtggtcttgacgaatatggttggaagaaaaggttacaagaaaattttctttcaaaggttttgaaccacaaggacatgaggatatgccatttaggtgcagtaaaagaaaacctatgcgaccagaaagtgcttatcattcttgatgacgtgaacagtctaaagcaattagaggcgttggctaatgagagtgcatggtttggtcctgggagtaggattgtagtgaccacagaaaacctagagattttgcagcaacatggtatcggtagcacttaccatgtggggtttccatttgatgaagaagctatcgagatcttatgtagatgtgcttttagactaaggtctccactttatggttttgaggtgctttgtacaaggataataaggctttgtggtaatcttccattggctctatgtgtggtgggtaaatctttacgtgggaagaagaaggacgaatgggaagatgtagtgaacagactggaaactattcttgatcaaggtatagaggacgtgctaaaagtgggctatgaaagtttagaggagaatgagcaaaccctatttctccacattgcagtcttcttcaacaatgaagatagtgatcttgtgaaagccatgttctctgacggtacaatagatgtcaaacgcggtttgcagatcctagtctatagatctctcatagagatatctacatatgggaatataatcgagatgcacaagctactacgacgagtgggtagacaagccattcataaacaagagccttggaaacgccaaatcttactggatgcgcatgagatttgcgatgtcctcgaaaacgaaacaggaactagagctgtgtccggcatatcatttgatatatcaggaatcaacgacctgattgttgacgaaagagcttttaaaagaatgtataatcttcagtttctcaaagtctacaaaagcagagatgacaaactaaaatttgacattcttgctggggaaaaaagcagagatgatatgaatgatgtaatacatatacctgaggagatgaagtttccacgccgtctaaggtttctacattggaatgcataccctaacaagtgtcttcctccttcctttcatcctgaatatctcgtggaacttgatatgaagcatggcaaattcgagcacctctggaaaggaacccagcggcttgcaaatctcaagaagcttgatctgtcattttcatgccagttgaaggaactcccggatctttcaagagcaacaaatctgaagatattggatatgagttattgcaagagtttggtagagattccatcctcttttatgcatcttcagaaactagaattgtggtggatggatgattgcgtaaacctacaagtcattccagaccacctgaacttggcttctcttggaattgtcgaaatgaacggatgttcaaaattgagaaagtttctgtttatttcaactacttcaccgagattgagtatatgtggggactcttttcgacaacggccgccatcatctggtatgtactctcgtataaggaaaagtgggaaactcaagggattaacacatctccacaagagtctaatatgtctagacctacggtattctgatattgagacgattccagattgcatcaaagatcttcatcagctagagcaactctcccttgatggatgtagaagactcgcatcattgccagagctccctggttcgatcaaatccttaaatgcggaagattgcgaatcactggagaccgtgttttgccctttgaatagcagtccaaatgcagtactcgatttcaccaactgcttcaaattaggccaacaagcacgaagagaaattatccaccgttccttgtcttgtgaatgggttatcttaccaggaaaaaaagtacctgccaagtttgatcaccgagccagaggaagttcattgaccattagaattccctatggtaacaatcctctttctgctgtatctatattgaagctttgcgttgtggtgtcacctaaccatcaaatcagcaaaaaaagtagacattcagaatacttagtgtgccgctgcataagcaaaggcgacctagaccccgttgttgaggagttttgcgtaagctatgtctccagatatcgatctgaacatctacttatatttcaccctcgcttgccattcatcgtcccctccgaagtcagcagagagacagtgttcgaattcagcagcaaatctcacgaattcgacgttattgaatgtggtgccaaagtgtttgaagacaagagcatccaagggagctatgaatctggatcagaccaagtgtctgaagaccacattgattacctcactgatgggaggtacgaatcatgtgaagacgatattaatagtctgatcgacgagagccttgagttgaacccagcgaatcctttacaggcgacaccgtatgaatcgagtgaggagcgcgaatggagtgaggacgaatacgaattgagtgaacagtaccgccaaagcagacgacaatttcgagctcagtgccgccgaagaagatctagcatcttcgagaagtcacctttcctcggtaccgaaaccatggttgaaacacgactccaagagagatctctgactgagcaagttgacgagttacggtccttacacgacctcctcgctgctgagcttaagtctcgttccgactccctcgacgctcgtttcgacagactcgaggccctgatgttctccgccaacgcctcaccgctccacgccaccggaaaagccccactagaccccggcccctcccaccctccgacacccttcaacctcggttcttcccaaccacctgaccccccagatctcaacggattccgtcaacacaacgagtttggcagactcacatctcgcctttccaaaatctcgttcccaaagttcgatggcactgacctccgcgactggctttccaagtgtgagcagttctttgatatcgacggcacctcacaggagctgaaggtacgcttagctgcgatgcatctcaccggaagagctactcaatggcacacaaactacatgagcactaggtttggcatgttcccctcttggacagactatataatcgccatatctgctcgtttttgtgaactctttgacgaccctcttgctgagctagtggccctcaagcaaggctccgatttggttgctgcctatctcgacaagtttgagacgacaaggatgcgccttgtccttcctgaggctcatgctcttagcattttcctggctaacatgaaccctcatctctctctccacacgagacagtttgaaacaacctccattgcgggcgctgcaaagattgctatgctccatgaatcctctctctcccataccccaaaccgacaaagagcccccttcaatccttacccaaacacaaaaccctaccaaaaaccaaacaacccttcccccctcctacctctaacccaagcccccaccaaccaaaaaccctcctttattccccgaaaccccactgacaaaccacctcgaaagttctcctaccaggaaatgcaagacagaagatcgaaaggcttatgtatgttttgtgatgaaccatttactcctggccatcaactaaaacacaagcgctctcagatctatgtcatggagtgtgatgatgctgataccatccctgacgatagctcctctgatgccgagccagagtcagacgacaagcaagcgactgttgaagtcacaccagtcatctccatcaatgccttaaacggctccacctcctacaactgtatgcgcttgattggtcatcacggcaaacacaagctgcatatacttgtagaccctggaagtacccacaactttgtggacctcaacatcgccactcaactgggttgtgagctcgaaccaacgcgcccaatgtcagtgaaagctgcaactggtgacacccttctcacaaacttcaagtgctcggctttcacttggaccgttcaaggctcctcctttacgacggaaatccgcactgtccctcttgactgctgcgattttgtgcttggagtgcaatggctttgcactttgggacctattctttgggacttcctcaacctcagaatggagttcacactctctggcaccaaacatgtacttcgtggcgtcgttaagacaggaggcaaggttattaagggctccagcttgaacaagctcatgctccaagaacctcaaatagccttaatccagctacaacagattgatgagaatgccgacaaccagcaaagcctcaatcctgaaatgttgtactctcacatctctgcttcgggaacaacaaatgctgacgacccagctctccaacaacttcttcaaacgtttgaagatatctttcaagaacctaagtcactgccaccgtttagagagggttttgatcaccagataccactccttgcgggctccaaccccgtcaacttacgcccgtatcggtactcttctcttcaaaaagatacaatcgatacgatgatcaaggaaatgctgactcaagggatcattcagcacagtgctagcccctacgcctcacccatcgtcttggtcaagaaaaaagatggcacgtggcgtctttgtgtggattacagagggctcaacaagcagacgatcaaggacaagtatctgatccctctgctagaagacctcctcgatgaacttggtggcgccaagtacttctctaagttggatcttcgagcaggttttcaccaactccgaatgtcggaggatgacgtctacaagacagcattcaagacacatcaagggcactatgaataccttgtcatgcctttcggcttgacaaacgccccttgcactttccagagtcttatgaatcatgtatttcaagacctctctcggaaatcagtgcttgtctttttcgacgacatccttgtatacagcaagacttgggaggaacacctacaacaccttgcggaggtcttcctgatcctgcaacaacaacagctgtatctcaaactctctaaatgtactattggtgcaacgatcatagagtaccttggccactttatttctgctgacggcgtgagcaccgatccccgaaagattgctgtaatacgtgattggccaatccctacgacacagaagcacctacggagcttcttgggattggcaaactattaccgccgcttcatcaaaggttatagctccatcgctcgccccctcagcacgctactgaaaaaagatggctttacttggtcccttgaagctgatcaatccttctcagacctcaaagcagcgctcagttccacgcctgtcttagccctccccgactttgatcaacctttcattgttgagacagacgcgtcaaacaccggtattggtgcggtccttatgcagggaaaacaccctatctgcttcataagtcgctcccttggtccccgccaccaaaacctgtctgtgtatgaaaaggagttgatggcattagtgcacgcagtgcaaacctggcacccctaccttgcgcatcgccctttcatcatcaacactgatcagcgaagcctcaagtacctcatggagcagaaaataactacacctttccagcacatgtggctctctaagcttatgggctacaacttcgagatccactacaagcaagggaaagacaatgttgttgctgacgctctctctcgagtctctggctctcagttactgaacatggtactatctcaggctcatactggtttctacgattcgttgaagctactctgggaaaccgatgctactctccagaagattatctgcgacttgaaatctaacagctcttcacaccccctcttcacatacacaaacggagagctgagacgtcgaggcaagctagtcgttggaaacgataaagatatcaagttgcacatcttcaaatggcttcacgactctgccattgggggacactctggacgtgacgcaaccttacatcgtatcagatctttgttctattggcctaagctaaacgtggaggtccagaactacattcgaaactgtagtatctgccaacagaacaagtacgatatggctgccaaaccgggtcttctacaacctctaccaattcctgatgggatctgggaatctataagcctagacttcattgaaggtctcccgccgtctcagggcaaacactgtattatggtagtggtcgataggatgagcaagaacgcacactttatacccttgtcccacccatacacggccctcactgttgctcaggcattcttggacaacatcttcaaactccatggcatgcccaaagatgtcatcagtgacagagatccgatctttatcagtgaggtttggaacgagctcttccgtgtacaaggggttactctcaagcgctccactgcttaccaccctcaaaccgacggtcaaacagaggtaaccaacaagaccttggagacctatctacgctgtatggctgctgagacaccaacatcctggagcaaatggctcagtcttgcagaatggtggtataacaccacttttcactctgccattcaagctactccatacgaggtcatctacggtcaacccccaccacttcacctcccttaccttccgggtgaaagctcctccgttgttgtagaccgcagcctccagaagcgtgaggaagtgattaacatgcttaaatttcacttgcttcgcgctcagaaccgtatgcggcagtatgccgatgcaaagcgttcccagcgagagttcaagatcggtgattacgtatacttgaagctccagccatatcgccagcatacagtgaaaaagaataaggctccacacaagctctcgccacgcttttatggtcccttccgtgtgctagaccgtatcggcaaggttgcctacaaactctcgctgcctactgaagctgcaattcatgacacatttcactactggcttgacctcggcaacaccaaagaacctgcagcaattctggagactaagactgttaagcgccaaaacgaagctgcaacaaaagttttagtccactggaaagatgaatcacctgaaatggcaacttgggagttctacaaggacttcaccaacaagtatcctcttttcaatccttga

SEQ ID NO: 87 - DNA, 271990 bp, Raphanus sativum
  modified_base (144241)..(144300): a, t, c, g, other or unknown
tggttttcatcccactcttgttaccttcaacacccttctccacggattatgtgtggaagatagggtttctgaagccttggatttgtttcatcaaatgtgtaaaccaaatgtcgtaaccttcaccacgctgatgaacggtctttgccgcgagggtagagttgtcgaggccgtagctctgcttgatcggatggtagaagatggtctccagcctaaccagattacttacggaacaattgtagatgggatgtgtaagatgggagacactgtgtctgcattgaatcttctgaggaagatggaggagttgagccacatcaaaccggatgtggtaatctatagtgccatcattgatggcctttggaaagacggacgtcataccgatgctcaaaatcttttcattgaaatgcaagacaagggaatctttccagatatagttacctacagctgtatgattaatggattttgtagctctggtaaatggagtgaagcccagcgcttgttgcaagaaatgttagtaaggaagatcagccctgatgttgtaactttcagtggattgatcaatgcattggtcaaagagggcgatcttaattctgctcaagaccttttacaggagatgatttctagtggtgtgtgccctaatgtcgttacttgtaacactttgctggacggtctctgcgatcgcgggaaactaaaagatgcattggaaatgtttaaggctatgcagaagagtatgatggacattgatgctactcatgccttcaatggtgtggaacctgatgttcaaacttacaatatattgatcagcggattgattaatgaagggaagtttttagaggccgaggaattatacgaggagatgccccacaggggtatagtcccagatactgttacctatagctcaatgatcaatggattatgcaagcagagtcgcctagatgaggctacacaaatgtttgattcgatgggtagcaagagcttctctccaaacatagtgacatttaacacactcattactggctactgtaaggcaggaatggttgatgacgggctggagcttttctgcgagatgggtcgaagagggatagttgctaatgcaattacttacatcactttgattcgtggttttcgtaaagtgggtaatattaatgggtctctagacattttccaggagatgatttcaagtggtgtgtatcctgataccattactatccgcaatatgctgactggtttatggagtaaagaggaactaaaaagggcactggcaatgcttgaggaactgcagatgagtatggtatgtaagtttctgttcagtctatgttatttttaatatgaagaagaatgtatacatgcttttgtgtgtagcttcagattgatgatacatgttctggaattaaccatcggtttggttttgcattgtaggatcatcatttggtggggtgaatgatcaaagatttttctactctttgcagcagagcttcaatgcattttgtttttgttgctgcatttgtaccctactaatgtttgatcaaatcgtggaatagagtgatcatagtgtaaaaattgtgtggtcaatgagctgttttgctgctattctaatgacagcctttatgcgtctattgtagtttaataaatttgaccatttccaattaagttccatacacttgttcacgcaagattattggtgcgaaataaagaagcacaccttccagaagacttcaggtgttaaaagatgtttagtgtttaatctttcgatcccactttttgtttgtttgtatgcaggtatattagttggtaacatggaaaatattctcctttattaccttgaagtagtgatattgtctggtttagttaaactcgtattatcctaactggtagtatccatgagattcaattggtatgtgcctgtctacaacataggagttcttctctatgatcattctatttcaaaatatttatatgtttcaggtgtgaggcaggtcaattagtggcaaggaagcttatcctcaacttggttcataattttctgcagaaagaaacattggttctcagctcaaaatatgttatcatcaaccaggtaatcgtatttaagacaatccaacacaccctgcttcacatgcacctttcaaaattttaagagatacaaggtgataacgaattttatttataccgagagagtagactacatgtcgaacgtgtttaatgataagcgcaaacgagaaaaaaacaaccttcaagaacgagtaatgtgctttggcatgcacttattaagagaatagattaattgtatacagaagccaaaatgatttgttcttgaagctacgaatcaatctgtatgttcagattctcgacgatctcttctagcttgagttttccctttcctttccctccaccccctcccaggtgccttcatcaaaggtttctccacatcgcctgagatatcaagatgaactcctggatcatgagtctcgtactttgcgcccatcattatggagttgttcacagcttgaaagttgctgtttacaaaagtggtcaggaaatcaagctcttgcccaccgtttttgtagctgtctccatggttatcatcaagctcggtcttcatggtggctccaaggttggatccagagagcgtgatggctctgatgccatcctcctcctccttctcctcttcttcatattggttccgtcctgccttgtctgctcccatgtgggttaaggaggagatcatgtttttaagatcgtggtggaaatgttggtgttggttgtccttcgctgattcgcctcctcttgatttgcttagcttcattctaagttttgcacaaccagaagagagtatgggaaggcaagtaatgcaaaccatacatctctaaatatatatatttataaatatcactatatcagagtaaacgcaatgccttgtgttgtaagtaaaggaaggggaatgactttggaatgggtttaagaataacctttggagattgagaaatgtggttaggtatcacgataagatgttgcagttaaataattggatgatgtcaaaaccgtaggagattcagagttctttcattgtaataataaaaacaacacacttgagaccatgtcgatagttctcttccaacataaaaaccaattggttataaaagatcgtcatcacatcatagatgagttaaatcttgacccgaaggttgaaatcaagtcttctttttccagctagaagctttgttaggacttgcatacatataacaattagatatggggaaagggaacacccttgtctatgacatctttcgctattaacatacctagtcaatttccccatttatctaaaccgagaaagatgtcagctcaatacactttttttatccaaacacagaggagacaactcgcattgctctgttttccttcacacatgcatctatgtagcaaacaacaaaactgaaatgaactcttcctgatccattcccaaatcctttatggttttgacgtgtattgaaacctctgatactccacaagtacatcaaattctttttgttcaaaaatactaggacctttattcttagacttttgaaaattttgattctgatagaaacttatggtttatccttagacccctctaggaagagattgtctttgagtaatcacctctttctctttagtttatcttatttctctgcctcttcaggaacatctacacaagatatgtctccactatttcaccttgcttttcagttgaacttagaacggagaatattgagttcaatagtatggttaggacatctgctacctttccttggtgtgttttctattcactcttgttccataaatttggatcttcttaagtttttgcaatcacttccacggaagcacaagcctcagtaacctcacaaaaaaaaaatctccacttctacaacctcagaatcagtctctgcgtttttttatgatactcgtgcttcctgtatccttttctttagtttggtgtttgcaagacgtaattttctcattaatgtttgttacccactgagaaaggtttcattatcacccttttccttctcactcaagtcttctttctcaacttccttttccacatgtttctcgctagtagctctacatgcttttatcaagaacaaaactttaccctaaagtgaacctctacattcacccaccaataggaattagttaattgagatttgatatcttttaaaaaatgaaaccaaataataagaatttaatgaaataaaattatgtttttagataaataaaaattagtagcaattataaaaaaaaattttaatattgataaatccgtcagaaaatactaaaccctaaaccctaaattctaaaccctaaaccttaaattctaaatactaaaccctaaaccctaggaaaaagcctgaacccttgggcaaatcctataccctaacccttaaatttaaaccaaaccttaaatcataaactaaatcctaatccctaaaccctaaattataacccctaatactaaaccctaaatcctaaattccaaaatggtttatggtttaggattaaggatttatgatttaatatttgtcaaagagtttagggtttaggggttcgtgtttagaatttagggtttaatattattgtttatgattaagggtttaggttttaagattaacgatttaggatataggatttgccaaaaggttcaggctttccccaagggtttagggtttagtatttagaattttgggtttagggtttagggtttagggtttagtattttctgacggatttatcaatattaaaaaaaaaaaattataattgctactattttttatttatctaaaaatataattttatttaattaaatttttattacttggtttccttttttaagagatatcaaatcttaattaactaatttctattggtgggtgaatgtagagattcaccttagggggtgaagctaagttttgttcttttatcaaatgaccccagttaccgtatgttatgcttgaaccgatcgagataatttttttctaaaattgttatttttaattttaaatctaatcatatatattttttaaaattctaaacccctgaaaaaaaaaactccacccccttttccaaaatttaaattagttaatcttatgtgtatagacatcttttaccttgttagtatactagtcattatgatccttttatactatatatttgtgataaacaatcattttttggctttactagaatattgatcatacttttatgactgaaaaataaataaaaacaaatattatataatgggctacaccacgattagaaaacataatctctccgtttcataaatatgtatgttttaggaaaaaaatattgttttaaaaaagtgtattttttatattttcagtgcagttcttatcaacaaataataaaaaattgtgtgttttaaaaacattaattatatttttaaaaattttatttgtttaaaaatataggaaatatagaattacaaaaaactatgtattaataactaagttttcatatatttttttgataagtgtgaaaatcctaaaatatctattattttgaaacaaaatgagtatatttttcctttttgatcatttttttttgttttttttttttttggttttctcaaacatacagctggaaagcaaaaggaaaagtaaaacaacaaaacagttaaagcctaaaacccacaagtgggctctgtttagccggtagccaataacacgacggttaaaatgtcgtatatgattatcataatacgaaactgacgtaatttacacgatcgagtaataagtttagtagatgaaattccaaaattcaaagagtgtagtaaaacaagtccattattatatcatcatcatcaatgtcgtgtccttgtcaaactcacgcagacatgcatcttctttccattttcttttcctgcttaaattttctttaacttcaaataaacgaaattaagagaacaaacacaaaaagagagactggaagcaagagagagagagagagagatcaacaaaaacaaagtagactaagaaaagattccttagtctccaaagattcccccttagtatccaaaaaaatatcataacaatgacatctctcttctccaaagcccgagctctcacttctctgggctcctactttaaaacgtaccgtccggtcaccggaaaactccatgtggccaccttgacgcttctcctcttccttctcgcagccgctgttgccgtcacctcttctctatggcttagtaaggtataattaattaagaaaaataatcttaatataacgttatcaagaaaattaacataatctttttttgttgatcaaagacgacgaaacaatttgatacaccgacattagtcacaagaaaaccggtacccgagctagaatcaccgaagaaaaccggagtactggtaaatggcacaagtttattgaatcaaaaccggtctggttcttactcagaaacatctctatggcttaacaaggtaattattatcgagatcttttcattacgtaattaaaattctaatactattttcagtaatttcaactttttgttgtttaccacagacaaaatcatataatcagccgacaataataacaacaaaaccggttcacgtaccagtaccagtaccagagaagaaatcaacgaagaaaaccggaatctcggtagattgcacaagtttcttgaaccaaaaccggtccggttcttgctcgagaacagctcaacccggctataataataaccaaaccgaatcgaaccggtcatgtcctgattacttcaagtggatccacgaggatctaaagccatggagagagacggggataacgagagaaatggtggagagaggacaaacgacagcgcatttcaggttagttatagtaaacggcaaagtgttcgtcgaaaactacaagaagtctatacagactagagacgagttcacactgtgggggattcttcagctgctgagaaagtatccagggaagttgcctgacgtggatctcatgttcgactgtgatgatcggcctgttattagattggacggttacagtaaatctaatcatacagctgaaaatgcaccacctgcgttatttagatacggcggagatagatggacggcggatgtcgtctttccagactggtcattctggggatggtatgtactagaatatatctctacactttccctccttttcttcttttgttttctctgtctgaagcgtgtagggttgtcaacatgcaattgtccccacttttgatcacatgccgcaaaaaaagattcatttttttgtttatatatagtaatttaaagggttcgaaaaagtagaattaaatgattgagtactctccactcaatgtcactactagttaaatatgaggttgtagctaatttatccctatttttcgttccaaaaaaagctaatttatttatgctttgaataagtgattagctaaaagtaactttaatttttatatcgcgaacggaactttaatttttatataattcaatctttacagcaaaacattaagtaagtgtttttttttttgataaaagatttaacattaagtaagtgttttgttccaaaatcttattggtaaattcatattgaactttgaaatattgttttgtatcaattgtcatatttgtttttctgatgatttatttgcatagttgaaaattttaataagttgaaaatcaaataaactgaaataaattggattaaattggtggataaaggcaagagattaacataaagccatggagcaaagtgttgacagaaatggaaaaaggaaagaagaagaagaaatttatggagagagaagcttatgcatattggaaagggaacccttttgttgcatctccttcgagagaagatcttcttacttgcaatgtatcctcacaacatgattggaatgctagaattttcattcaggtatatatatatatatatatatatatgcttctataagcttatgttcgtacgtataaccctattttatctattaatttttccatgaggtataataacaatgttgataaaaataggtataataacaatgaatttgtgagcaatattttctttgtgtttacacaggattggatatcagaaggacaaaaaggatttgagaattcaaatgtagcagatcaatgcacttacaagttagtactagtctatacattttgcctcatatagtaccaatgtctaatttgagttgaggttttttatatatatgttgattttaattattgagataataagttgtgcaggtacaagatatatatagaagggtatggatggtcagtgagtgagaaatacatattggcatgcgactcagttacattgatggtgaaaccatattactatgatttcttctcaagaactcttcaacctctccaacactattggcccattaatgataaggataaatgtagatccatcaaatttgctgttgactggcttaataatcacactcaaaaggtatcattaccaatcttttttttatctcagtctagataatctttcttacatgatcaattttccctccaccaaactacaccttgaataggattttagcttaagtaaaaaaaagtagatcccctagtttacaaaaagtaatttatgtatatatatagtactcgagtaattagtttcagtttttttttttttgcgaaataattagttttaattttgtaaggaaagtttttcattttatctttcgaatataatctacaaaatagttgtctatacctataagttaatactgtgattagataaaatcttgctatttttctttattgttgaaataaagtaccaaaaacacatgttgcgtaatactttgaaaagttggatcgcataattatgcatactttttgtttataattggttgcaatgcaggctcaagagattggaaggggagcaagtgagttcatgcaacgagatctatcaatggaaaacgtgtatgattacatgttccatttgttgaatgaatactcaaagcttcttaagttcaagcctcaagttccccaaaacagtgttgaaatctgcacagaagcaatggtgtgcccttctggagatgctaatgatactaataagagatttttgatgggctctttagtcgatgagcctcacaattcaggcccatgttcgctacctcctccttttgatcccaacggtctcgagaagttttataggaagaaactgaatctcatccggcaagttgagaaatgggagcacgcttactgggaaaacgttcaataaaatgattgtattaaactgtttgatatgattttattttagcttttatatatcggatcacgttagaataatgataattttgagaaatatataattccttcatcagcacacagatggtccacataataacatatgcagcttcttagcatgagtagatcaatttcctcaacctaaatcgagcccattgaaacctgctgaactaatagatcgtgttaatagcttttatttatatgtagtacattatattatatctaccataattaaggtgaatgactgtgtgagcttgaagcttcttattttattttagcacggctcatttacatgtgtattttatttgtaaaagactggatacatgttttgctatataatagttcatgtatttgaatgttcttgaagattaaaaaggcatgtgaggctactgcgatatgattgtagtgggaacttaatgaccaatttcatgtgaatgcttaaaagatatgggacagttgtagttaaaactaaaaagtttgttttcctgccttgacgaatgacgaatacaaattaagttcatctattctattaattcttcaacatgtcctattgatatttagttgtgtccaactgattttttttataactgtatctaataatttaattaaatcaataacatgttctctttgtataataagcagttacgttttcttccaacactaagaaagagtttttgtcggtttatgattttaaaattgggccatgggcttcgatttcgttttaaaaatcaactgatttgttacatttggtctgattgcaatggccatataaatttatattgctttcttaaccacatttaggtttatggttaatttaattttaatagaagaagactaataatattgattattaaaaccataattttatataagattactattatatctataataatttatagatatttgtttactattatatctattagcataactgtatgtatatatatatatatatatatatatattatttatagtttgcattgcaacatttttaataaactaaaaaattagtatattttaattttaaaataaatcttcaatttgtattcataaatttatgattagaaagttaataataaaatagtaataattaatttcagacatatttacagaaaaaaatacaaaacaacactatatatgcgcttcaagcacagatcaagatctaatataggtctaacattttaccggacccgaagaaccaaactagaacggatccgaaaatacaggttcagatccgagtctatgctaaaatatttattggatcttttttatggggacccacaagtttcggtttggatctacgtcctacaagagacccaatcgggtattcgaaatactcaaaaattattatatattaggtaaatttggatgattttgtgtattttggatatttcagatatttttttaagtttcaggttaaggtttttaggtataatttcaggtttcgggtaaattttagatttctaaaaaatataatttgggtgttcgggtaaaatttgagataccttttgggttttcggatctgattttgggtaagtttcagatatattttctccaggtatttttaggatttgcaggtacttttcgagttttcaaattcagtttggatatgtctaggcctaatctgaatagataaatatgattacaaaaaatagatttataattataaagaaacgagtgtatgccggccaactttaaattattattatttatacagtaaatcaaatagattttgattaagatttatatacatatatgactacaaaaaaatatgattaagaaaaaaaacacaagtatctattctattaattcttcaacatgtcctattgatatttagttgtgtccaactgattttttttataactgtatctaataatttaattaaatcaataacatgttctctttgtataataagcagttacgttttcttccaacactaagaaagagtttttgtcggtttatgattttaaaattgggccatgggcttcgatttcgttttaaaaatcaactgatttgttacatttggtctgattgcaatggccatataaatttatattgctttcttaaccacatttaggtttatggttaatttaattttaatagaagaagactaataatattgattattaaaaccataattttatataagattactattatatctataataatttatagatatttgtttactattatatctattagcataactgtatgtatatatatatatatatatatatatattatttatagtttgcattgcaacatttttaataaactaaaaaattagtatattttaattttaaaataaatcttcaatttgtattcataaatttatgattagaaagttaataataaaatagtaataattaatttcagacatatttacagaaaaaaatacaaaacaacactatatatgcgcttcaagcacagatcaagatctaatataggtctaacattttaccggacccgaagaaccaaactagaacggatccgaaaatacaggttcagatccgagtctatgctaaaatatttattggatcttttttatggggacccacaagtttcggtttggatctacgtcctacaagagacccaatcgggtattcgaaatactcaaaaattattatatattaggtaaatttggatgattttgtgtattttggatatttcagatatttttttaagtttcaggttaaggtttttaggtataatttcaggtttcgggtaaattttagatttctaaaaaatataatttgggtgttcgggtaaaatttgagatacctttcgggttttcggatctgattttgggtaagtttcagatatattttctccaggtatttttaggatttgcaggtacttttcgagttttcaaattcagtttggatatgtctaggcctaatctgaatagataaatatgattacaaaaaatagatttataattataaagaaacgagtgtatgccggccaactttaaattattattatttatacagtaaatcaaatagattttgattaagatttatatacatatatgactacaaaaaaatatgattaagaaaaaaaacacaagtattacaattaaatatctagaaaaagttaaacaaaaatatacatgtcattttgaaagggcgggtcagaatctagattctgaagaccgaatgttctcaaatattaaaaaaaatagtttcatttaaaataaaaaatcatataaactttttaaaatacacaaaaacagattttatcaatacataacgggtctatagcaaaaaacaatagtttaaaaatattaaactttttatttaaattaaaatactaaaatcactgtgaaataattcacaagtttaacagcaggttaataaacaaaaatcataatacggataagaattatttggagtttttaaaattttggtcatatttaaaataacaaaaataattcatacaataattttagataaatttcataaaattcttaacaaatataatttatcaaggatacaaaatattcatgacataaacttaattgtttcaacaaaaaatatatccgccctctgaagggcgggtcagaatctagttcaatgttaatcttataagcatgaataattatttgataaatttatttttgtttttaaaataattatgcgttttatcatctactactttctagtcacttgtcttttagttttctacacacataacttgccatttcaaaaatatttacgatgttaagttcaaaaaaaaatatatatatatttacgatggcgatattttacaaggcatttggttactcgttttgtttgctcaaaaaaaatgtatgtgaatacattaaaacatcaaaaataaataccctctccgtttttaaaatgatatatgttttaaagtaaaagttgttttgaaaaatattttttatattttcaatattttattagatagtgaattgtatcaagagtttaaaaaactaattgtatttattaaattttgattggataaaaaatttgtggaaagtaattaatcacaaaataatatatttaaattcaaaatttttaatgtggatgaaaattcaaaaacctacattttaaaaatcgattgagtgtattagacgaacatgacgtatatttattgtgtcaaagagcgtagtaactgttattggttgtctcattattaatgcatatcataatgttagtttgttaattttcattaaatggccttttccttttcacgtgagtattattggcggtgaatatttttaagtctgatttttctcatacaaaaggacatagtatgtaaatttgtaagacttgataaaatgttttttaaaagaaaaatgttaagaacagaataacctagtttgttggcaaataaatatttatccttaaacatattccatactttgttttgagtgattcaaatttactactccttccgtttcttaaagttagatattttagaagaaaaatatttttaaaagatctacattttacattttcaatgcatgttttattatctaattgcaaatttcgaaaatttaattttacttattgaatttttattggcttaaaattatggaagaaaaataaagacaagattattcaaatttaatgtgttttattaaaatttgtgaaaaatctagaatatgtaactttagaaaatagaaagaatatatcagaaaaaaaactaaacgtagatctgacaatttttcaattgaagcttaaccactatgttcaatatctttgacgaaaatgtctcgtaaaggcctgactggttcaaacgcatcgattgcggttacgggtgcgggagtttgtggatgtggtggctgtagtttcaagcgttatttagagttttgtatgattggcataatatttttgaatttttacgtttgcgaaatatttgtaactggttgattatgagatattacaacagtttaataataaattatcaatataaacatattataatatataaaaatataaaaacatgctattgtgataaaattaattattattaatataatatgattaataataatgttgtatttattttttaatattttaattagttgaaagttataatttaatttaaaaattgaagatttatatttaaaaaaataaagaagattttgtttcgttttatatatgtatatatctttatatatgtatgcatattaattttaaaaagtatctattgaatacctagtttaaagtttttacaaaacaaattatgataccgtttgtgaatttgaattaatatatataatttatatatttttatttatattatttccattttaattttaaattttaaaatgtataaaaaatatttttttatctatgcgcaaccgtaaacgctaactgcaaccagcttttgattttaaaaggtttgaagcggtttgaaacgatttatagcggtttatatgattgttttgaaacattgtcaaccgctatcaaccgcaaaaattgcgtttgcaggtggtagcacagaaaccagtgaagccctaaatagtgtaaaatatctaaaaattataccttacttttatacctagtatgtaagtttcctatataaatttggtgtcatcacaaagtttcattatggtccttatcgatttcccttagtgtatactcaatgttttgcttgtaagcatcgggtgtgacgacttggaacctaattcatgtccaaacagataagcataattattatttgtcattcgtatatgtatattattgtttagttaggaaatatttaacgtatatcgttttagctaaaatcgtgatgaaagaaaaggcactaaaaaccgatatagttaatttaagattaaatacataaataatagaaatatcaaaagacaagagatttaacgcattgacgtccggtgtttttctccggagtggaaagtcttttctcccactacaagaaaaaatgcttttattagcggacgaaaaacgctatctaacgatacgatggcggtttatgaagcgttgtatcatcggccgtcataatagatcagacatattagatagcgtttttttgccctgctatcgtattgttatatattatagcgttttctgatttgcaattaaatattctttaatagcgtttttttttgttattatttaatatttatttgtttattttaaaattatttaatttaattattaaaaataaaaatataattaaattttagaattgatttatatatttaaaatttctttattatttaaacctatttacaattaattggtttacaaaaattgaaaaaataaaaaaaataaatctaattagataaaaaaatactaaaccaaataaaccaaaaacctaaaccaaagcttaaacctaattactaattaactaacgtatgccgccgcacaccaccacctacatcgtcttcttcatcttccaatcctcagccgcctcaccaccaccttcgtcgtcttctttaacgcccttcgtcgtcgcatcccgccatgattcttcttcttcgttgtgggatttgatagtcaagttgcagagaggaggcttactcgtcgtcgcatccagccaccttcgtcgtcattgtctcctctccacgaggcttgctcgccgtcttcccggtcgtcttctccaagtatcttgagtgacaatcgcagcagcagagttcagagtcgaaggcgccagaggcgaagtcgaaggtgccagaggcagagacaaaggcgcattgctaaatcaaactcaacatccgaactttaaaaaattagttgagaagaagataaaagatatagcagagaagactccaaagggaagaagaaagacagagagagtagatctgtttctcgtagagaagaaaagaaaaaaaaaatgaaacaaagaagagaagtacaaatgaattgttgtcgttagatcaaaactaatcttagggtttgtattgcaatccacgtgattcatgaattgaccaatagacaaacttctttatttttattttttacttttttttcgacaaccttttgtgttttttaataacaatatttttattttttgtttaaggttcgtgtacgtataataagtaataactatagattgatttaaaaggttggagtttgatttatgatttagagttttattacagtttaatgtttataatataaattttgtggtatggggtttagggtttatagtttatggtaagatttaatattaaataatgaaaataatttggtgtttaaattttcttctaatgcatatagtttgattgaagatttaaggtctgtgtgaatatctaccgaatttatatttataaaatgaatgatatataactttgacaaagtgactacatttcatttttagtgaaaatttataaatgcattttgatgcattatataactttgaaaagtgttgataaagtttggatctaatttttgaagcttataatagaagtaggaatatagggtttgagggttaaatttttgttttaagagtttagggtttgaaaacttgcttatagtttagagatttaaatttaagatctgatattcaaataagaacaattttgagttttaggggttgtgttttaaaaaattgggttttagggtttgaaatttagggtataagatttagatttttagaagcaaatgaaatggagtaggagggaaagtgaaaaaagaatgagagagaaaaacaattatatttttgccttagttatacatagcgttttgaaattgatagtgctatgtataatgcatttataaaaagagtttgtagcaataataacggaccaaccaaacatagcgtttccaaaaatacaaacgctatctaaaactaacggatatgtcaaccatagcagaaagcgaaaaaacgctatcctggtctgctattaaaacgcatttttcttgtagtgtcctcttttctatttcattttccttttgcccttttggtggatcttggccttcccgacgatatgcatggtgatttatggagtttggtggaggttcatgatgtagatatagccgtggatcagcaagttgtgtgaagtggatccaccgggatgggtcagcatttaggttgttgtggctgtaccgtcaaacgttttcatttttcgtttgacagtagcatacatcaagacagtaccggtactaagttttatcgggcccattcaaaaataacacatctatatatatctttttagtacacaatttagtttattgtaataattatatatttttaaaaactaatattgattaaattgacttttatttgttttagtatatatatttcattaacttaatttttattaatagaaaatttattagtttgatatgttttgatatttttctaattaaatgtataaaaatatcaatttcatataaaaaatttgcaacttaaaaaaaaaatgaaaaccacaaattggaaccatgccaatatttcatgggtttttagtcaagcctggcactgcatcgagatgaaggcgtatagtttcgatttcgtatctcctctatcgaccgagacgtggtttattagtgatggacctaactcacacccaaaagctagctcaagagtggaggattgtccaatcacatatatattgcccaaggatcacatcattaaacgatgtgggacattctaatagcccctctcgagatgtgggtgggaaacggtccaacacggaaacagcccaagcccaacatctcggacataccacagcaagatgggccatttttataggctacataagtagacaactattttatatgggaaatcatctgctgggcttaaccataggctctgataccatattagtgatgggcctaactcacacccaaaagctagcttaatagtggaggattgcccaatcacatgtatattgcccaaggatcacatcattaaacgatgtgggacattctaatatggttcaagattgaaattagtggggcgtgttagggcgtgaagagcaggctcggcacgtgggtggctccctatcttcaacctgccttgtgaatgacgaaggctttgtttccttgttgacaatacataaccagagtttaaggaggctaatggtgttaacttgattggcttgtgagttacgttctgttgagcttactttagtcgtggagagtcgtctataactcaaccggaaattggaaaaacaacacttcaacagtgtgagatcgaagttccgtcaacaacgtgatggtggctttaggaatagttgcactcttgttctcagatgcaggacgtgtgaaatttcaatttctcttggtcaatgagggagcttaaaccttggtaaggcttacattggagatatataatttgcagccgacaaaattgttttatccaatagatttgtctcttcttctgttatgaggtttgtgctagagcgtttgttgaagcctcaatctcaacccaactttcaggatgtctggccaatcaagtggaatcatgttgcttttggctacatattccaatataatggttgctgacatttataaggagaaaagtcttagtccctggctaaccgagaccattgaatgagaatatatatgcacctcttggtgttgtaattggaggtcatttttagcaatctgatcattcgataccatcttcttcgggctacaaatggagcttttttgttttgtaatagtggaaggtttagatatatctttataaccttattttagaggtaaaattaggtagtttaagaggtattttgctttgaatcatggaggtctctcatctcactgtggttaaaaatacagcttgtactctaggttgtatggatctgagtgtgtgtatacatccactaaatccttattctgaatttgtccaacattatgtgtatgtttaaacattgatatatccaacacgagaaattttagaaataaacaaatggaacacatatggaaaatcaaatggtgatagtatagtgataattttttggtgtttgatatgtattcacatcagttttgtgttcaatttcttttaaaaactaaattatcgttgtttggtaagtttggactttgaattttgctataagttgaattttggtataagtgattaacaaggtggatagtaatagacgatcgatctactccaaaacattagtcggaaaacaattcaatcttggattagacagtatgataaccaatcttttatataacactaaatatgtttttctgagattaactagattaaccgacatagtatataaaaaaaaaatacacgtatgagtaatttgtcccaatcttgtttgttgctcaattttatgaagttgcgatcagttaaggaaggccatttatataatttagatatatatatatatatatatatatatatatattgttataaaatttatattattaaaaatgaagtaactttaatactttttggaaacataaataacatgataaataagaattgtatagaaacatgtatagaagattatgtattttcttttctacacatttagccattgcattataataaattaagtactttctttttatatctctttttatatttatttttatttacatattctttttgtatcttttttagcagattaagtacttctttttaagtttttttttatttttgtatttcaatttaatttattaattaaactgtaattaattaattaatttaaattaattaatttcaatgcttattgttttttttggtgataaaaacaaaaactaatttttttagtatatattatataaaaaaagtgttaaatataatattatcttatttaattttgtcaaatataaaaattccgagaattacaattttcaagaaaacaaaatatcataaaactaataataattcatagaaaactaatgcaaaaaaataaaaaaattagtataatgttttattttaaaataaattaacaaaaaataacaaattaatatatgaataatacacttatatcaaattgcatcaaattataattttaaatataatattatgcaaaaataaaaaaattattaacaaaaatctatattataaaataatatattttactctagatgtaacaaaacataaaaatatatatgattttttataaaaatagcgatttattaaattagttgtaattaaataaagaaacgtagaatgtactagaaataaacgtgggggtttgttggatccatctaaattttatagtatgacatattgtaccaaacgttggacatatatgttctgtaactttgttgacattaataaaaaataataattatttaattagttgttgttgcttcttttagatcatttgattaattatttattttccaagctttgttgtgttcatttgcataatatttttatctactattcttatttaagtttgattttttttttttgaacaaaccttcgttacttcaaatactcaaactaaacagagttagagagacaagatagtgcagccttagccacatcatctgcctcctcattgtacttacgagaaacaaactcaaacgaaacagaattaaaaagagtacaaaggtgatcaatatcaaaaagaactccttgtgcttcaacaatcttctctttggtgttaatggccatgataagggacttggaatctgatcgaatgaccagcttacgcaaacccagagaccgtgccgcttttaagccagctttaaccgcaagagcttctgcaattagagcagagccgacgatgctgcggtttgatgaagagcgatggaaggtcttgttgctcatatctttgaagatgcacccaaatcctccaccactggtgccagcattccacgctgcatctacaaaacattgagcctccacatccaagttagaaacctgacgagcctagagaaagttatctgatggtgtagataggttctgtttcgctttctcttgttgggcggtttgccaaatccttgcttccttcagtgctaaggataccagttcttgctctgatccctctcggttctcaaaaatcaacatgtttctccctatccacaagtaccagaagatccaaggatagagatcagtttcaccaaggcccagtggtggcagattaactatgcgtcgcgaggtttgcaaaagagcttccggggaggtgatgatcgctgggtctggtttgaacatgacaggcaccagatcccaaacacgacgggcaaatgggcattgtagaaaaacatgacgctctgtttctatcaatccacatctcttacaacgcccttccacttgaatccctctgtgtaaaagatttgcaccaactggcaaatctttacttttgatcttccataggaaatgtttcagcttcggggaagttctaatttgccatatacagaggttccagttgaagtcagtcagctcttcaccacgatttgtcttccagtatgggtagcccgtcttggttgagtactctccagaacgtgtatggagccagcagagttcatccttcatgtggaactcgctaggaactagtttcaaaatgtgttcctcatactgaggtaagtgtagtctaatcgcaggcagatcccattcctttgtaatgccattcaaaaggtccgatactttcagctctttgttctgctctgtaggtggacccattggacacattggagtctttggggagagccaaggatcagaccaggcgttgatgtccgatccgttaccaataacccatcctaggccttggcgtaacacctctctgcccgctataactccacgccaaccatgagaagccgatttaggagctggagttgagaggaatggggtggagtgacagtacttccctgccagtgtttgagccagcaaggactctggaaacttcagtattcgccaggccaactttgctaacagagcatcattaaacttctcaatctcccgacatcccaaaccgccagctctcttaggtagagtaagagtactccaagcaacccaagacattttacgatgatctggtttatcgtcccaccaaaagcgagtgagcacagtttgtatctgtttgcagagtgacttaggcaacttgaagcacgtcatcgcataggtgggcatagcagagagaatagacttcaagaggaccaacttccctgcgccattgaggtacctagaggtccagctatgcgacttttgcctgatccgatcagtaatgctagcaaatatgtctctcttctttctgttgaagtgctctgggaggccaaggtatttacctatacccccctcacccacaatgttaagctccgctttgaccctgcgtcttgtttcaatgggtgttttggcagagaaggttatagcagacttcagacaattgatgctttggccagaagcaacctcatatttctcaaagatgttctttagttctttgcaagatatcgggtcactcttgcaaaagaacatcgtatcatcggcgaagaggagatgatttagaggtggtgaattgcgcgctaccttgatgccacacagctttccttgttcaaacgccttagagcagagtcccgataagacctcagagcacaaaataaataaatagggagacagcgggtcgccttgtcggatcccacgcgacggtacaacacaaccgtgagcgcccccattgatgaggtatgagtacgaaaccgagctaacacattccataatccaatgcacccatgtagggtggaagccaaatcggaccatgacatctctcaagaaactccactccagtcgatcataggccttactcatgtccgttttgacggccatggtgcaatgcttctttgctgatgaggtacagaggtaatgaaggatctcgtgagttatcagaacattgaaatagaacgaccagccacaaaggctgattggtgtggagagatcaatgaagggaggattggtttcagccttctgcacatgaccttcgcgatgaccttatagtgtgtagagcagagtgctatgggcctgtaatccgttactgtcttgggcgttttgatttttggtattaaccggacgtgagtctcgttaaaccgacgatgaagttgacccgagataaagaaatctctgacctcccgacagacttcttctcctatgatgtcccaaaatccctgatagaaactggccgaaaaaccgtcgggtcccggagctttgtctctatgaatagcgaacactgctcgcttgatctccaaatcatctggtatacttgtgagtgttgcattcatttcaggggagattctgggtgagatagcatcctctatgatctgagatttcccttgagacgccgatgtgaacagggtatcatagtactcttcaatagaggctgctatctgttcttctgcaaacacagcagtaccatcttgtttctcaagaacagagaatttattggcagccttgcggcttctagtaatggcatgaaagtagctggaattatggtctccgtgttgcagccagaggattctactacgttgacgccaatacttctcctcctcctcgtaggctttgtcaagctcgtttgtcaacatgccaatgatatctgtatcaggagtactgcttgatagcgcttcctccaacgccttttggaggctctggatagactccttgctattcagattttgttctctagaccatttgataatagcaaggcgtactcgacaaagcctcgaccatttaagtttgatttattttcatgaaaccactgatttcttttagaacatgttcagctgagttttgtagcttttctaagattcacacctctttctttttttactttctaaaagagtgttaattgttcatatgtatctactttttcacgactcaatgtaacatgtttatttaatcaaatcgcaagttcaatattacacaaaaagccaatgtaataaatttctgaagcaacttaaaacaataatatttgttttggatatgataatctaactagcttggaaaactagattttttggtgttagtgttgaaaacttcatatgcgatttgatgacgatgtttttgcagatatagcaaatttcatcagtaagagatcattctaatattggcaagtcaatcatgcatcatttttagagaaaattttctacgaagaccctaaatttgttattatcataaatatagtctctatagatttagtgtttagatttgaggagtgaagtttcttttttaggaaaggagtagggtttagagatttttttaaaaatataataaaaaaattttaaaatagtttcaaatgaatttttgaatttccaaaagataaaaaatttcgaattcgaaaacatataattcgaaaactataatttttgtcaactattttgtttgtttttgtttaaataattatttatatctatatatctattaagtaaggatataagagtttttggctttttaataaaacctttttaattcatttttctccttgtagattttttaataaagaaacctattttataattatttgagacaactgccccttacaaaaaggagagtatacaacaaagcacaactcttacgagtcaaaactgaaagctacttggtaaatatccttggacgacccctcactgaatcgactttgtctccatttgatgcattttcctattatgaatctacatggttatatatccaaaaataatagttgaaacaatatgtttgtgacagatctcaatcaatataaacctccaagcataagctcgcacgattggtggcgtaaattctgacggactcttttaccctcactataatagtggagtagtattatatataggaacacaactcattgcaagtattgaatgttgaccaaaaaaaaaaaagtcttctaataatttatgcaaactttgattaaaaaaaagttttatgtaaaagaagagtatatttaaattactcttttacagtttttttctcacggtgaacagattttatttattcctttttataaaaattacgatataaatctacttgtcatgttgaccaaaaaaaaaaatccacttatcattagatcgtaaaaacgctctagcgttgcaacttgcatgtatatgttcaacgactgattaaaatacaattcatagatgacatatacggactacggaagtactgtatgtcccaccataccaatagctagcctaacaggagcctagatcaccgtaccacagagatgttcttaatgattcaagttaaatcatttaacgcgctattacttcaatgattagcaacaatactatactctatatttaagaatcacccaacgaaatttgataatttcaaacactattctttttttttttgtgggcaaaatttccaacactattctagatagactttttgcgattggaatcaaaagctagcgtgtatatattcttgttatttgtagtaaagctctgaaacaaatcatttctaaaaacaatttgtactcgtaaaaaatatgatacgattttaacagatacggtagtgatttgccattatgtataaaataaaaatagcaattacgattgaaatttcacgcaaaagaatacaattgtagatatctgaatggtagtacaaatcaattcctgatttataaatatttggatatatcctgatcagcactagaattattttttgtcacataatttgttactattattattatatgaaattgaacttataaaaaaatgttataaattatttcattgcaatatttatagatttattatgctattattttaatttatattttaaaagacattttctaccatccaatgaaacaaaagacctgtctttgaatccaagtctctctctctctctctcaccccacacttcaccatctctgctaattctccaacttacttttttccccttttccaagtgagtttcctttgataataggatattagctaaatcctctaatctctaccatttcattctctctctttgctaatcttggagctcaaacatctctgtttcttcagagtagtactccacgaaagttgccgtctttaatgagtcgaacttgagagtgaatctccagaaagaaagaaaatgagatcgaactgttgttctttacctcttctacggctgtctcttcttcttggcctcttcttcatctcttgtgatgccttcgcctctaacgaaggtatgtgaagcttatttgcttaatcccagatctcagattctttggatcgaatcgttttctccaaccttagtctagacatctcaatcgaccatgagaaaaaaaaaaagattactatattttcccgagaaaatcagtagaatctgtcaaagttaaaagcttttaatttatacaaaatcatctctctaactctctgtgtacagttgaagctctaagaagattcaaggaagcaatctatgaagaccctttgctcgttatgtctaactggaacgaccccaattcacatccttgcgcttggtccggcgttacttgctctccctctaaagaccatgtcatcaagatgtaacactctctttatctgcaacaacatcacttcttttatgagtgagatttggcttgttgattttgatctttcttgtcgtgcagaaacatatctgcttcatctattaaagggtttcttgcgcctgagttgtgtcaattaaccttccttcaggaactgtacgctttccatctctctctctctctcttgacataatatatagtttgatgtttgtgattttgacaatcattgaatgcttctggtagagtcttacatgggaaccttctactcgggacaataccaaaggagattggcaagttgagtaatctcaagatcttggacttaggaaacaatcatctcatgggtcctatccccgctgaggtcgggagtttgtccagcattatcatcatgtaataaaaagactcaaccttttacagcaaccaaaactgacggtttcaataccttttcttcataatgacgcttttgtttcacattttgcagaaaccttcagtccaatggtttaacgggaaagctgccttcagagattggtaacttgaagtaccttaaagaacttcatatcgacaggaataggcttcagggaagtcttctcgccgctggatcatctggctatccgtcaaaattgtgagtttagcaaaatagtatgaaacacttctgtctgcaatggcaaatgttttaatgggattttggttttactcaactctgttgcaggttttcttcaaattcaagtgctaatactgctggtctgtgcaagtcttctcagttgaaagtagctgacttttcatacaacttctttgtgggaaacattccaaagtgtttggagcactttccaaggtattcttatcatctaggttgtctttttcgagctctagacatctccagttttgcttgagagtttctccttttttttatggtcaaaactaggacgagctttcaagggaactgcatgcaaaacaaggatcttaagcacagaccatcttcccaatgcggtgtgtaagatatagcttttttgttttcatttcatggcccagctggtcttggtttttactaaaatgtaataatccgtgggggcaggtaacgcacagctggtcaaaactcatgaaagtcccagctccccaccaaagcaccagtcagctgaaattgtggctaagcatcataaaacatcaagacctaagtggcttcttgcgcttgagatagtcacaggatcaatggtcgctttgttctgcctggttgcacttttctcagcagttcaccgctggcaaaacaggccttctctcatcattccttggaagaaatcttcaagcctaaaggaaaagttcgcagtctacgttggttagaaatcatcatctttccaaaaaaatcttccaacattccaattcaaacaactcaaaataagtgtggctttttgttctcttattactccagattctgaaatgctcaaggatgtctcgagattcacaaggcaagagcttgaggtggcgtgtgaagacttcagcaacatcattggtttatctgctgatagtcaggtctataaaggaacaatgaaaggtggacctgagattgctgtgatctctctttgcgtcaaagaagaagattggaccggatacctcgagctctatttccagagagaggtagcttctgctcatgttacaaagaaaaactgagccttttctaagccatttttgcactgtttcaggttgcagatttggctagactgaaccacgagaacgcagggaaactgctgggatactgcaaagagacctcaccgtttgcaagaatgcttgtttttgagtatgcatcaaacggaacgctatacgagcacctccactgtaaaaatctcaacttcctcatcagagcttttgtgttgcatcatactatactgttttagactatagattaacattgctatgataaatgttctgatgcagatggggaagcggctttggtatcatgggcaagacggatgaagattgtcataggcattgcacgcggtctcaagtaccttcatatggaactggatcctccatttacaatctctgagctgagctcaaacgcgatctatcttacagaagattttactcccaaggtaaaaagtaaagtgagaccagctttgttatctgaacaatacagttaagcttatgtttctatgatgcagctggttgattttgaatgctggaagacgattcttgcgagatcagagaagaatttgagaaatattaacagtgaaggtgcggtatgcgtgctcccaaacgcaatggagagtcgatatctggatgtgtctggtaatatatatgcatttggtgttcttttgctggagattgtgagtggaagacctcctttctgcaaagacagaggcttcttaattgaatgggtaaagaagaagctattctctctgaaaataccttaagctgtgagtaaactcctttttctttacaccccccgttacatgttgttgcaggcaaaggagtatcttgaaacaccagaggcaatgacgagtttggtggatccggagctgaagcattttaaccaagaagagcttgaaacggtgtgtgaggtggcgaggcaatgcttgaacagggatccgaacaacaacagcaacaataacaacaagccatcagtgcaggagttatgtgagacgttggagagtagaatcagtttgtcgatttccgcagagcttagatcatcatctttggcttgggctgagctcgcgcttgactcttgatgaggtagaggagagtcctgaatgatgatgaatggctaactggaaacaatgtaaatcagtcgacacgtttaaaagttgttattgttctcttatcttgacaagtgtgttgagtttcttacgtgttgctttgattagtgtgtttacagtgtgtttgtaaaggaagagataaacatagagtttgtaaaaagattttttaaatttggaaattctatgagaggttaaagaatgtgtgtgtagtgtgaaatagttttggaacttgtatgatgctatctttatgttatacatacggtgtcttccatattcattcagacaaagagtttgctggttgaattgaaatttcataaacgtcggattcaacttaataaaaaagtcttttgactattttaaaaagccgccaatttcatggctggtacgacttatctgttctcacgacgttgagtgccatcaaagctcagaccgccaggtataatagattccatcttaccttaaactggatatgtattagtaaatttcccgttgaattttttttttaaaatacattgtttttctagcacgcaacggttgcatagtacgccgccatatgccaaatatgtaacttgaaagaatttacttgtctttttcttgcaaatggagaagaaaataagatgacaaaagaaaaacaagtaaaactacttcacgctatagtttatatacagttcacatatattttatattctcttacgttcatttttgaaatattttaaataaaaatttgaattttactactccatagtataggatgtcataacagtgacataattatttaatcaaccaatattttagtgaacctaataaaggcatataccatttacttatttagacactgaatggtcaaaaccatactacggaatttagaatggtatttgtaaaagcacttttaatttaccaaataacagcaaggcaaacacttaaattttccactaagtaatggaatacagatcagaacacacagaaaacaatagtaaattattttgttcagttacactgattatttttacatattactaaaatatgttataaatacagttctcatagtctcatactggttattttctttatttctattttattttaaatatgaaaattatattacctattcttactaatatataaatgttataaaattactatatattttttttaaaaaaatatttctttataatataatatactttggcaatagaattttgtcatataaccataattaatttcactgaaagaattagatagaagagagtatttacggaaagaacccgatagtttggatatttatataatcggcgcatatattttgtcatttaccaaccgactcctttttccctctcatctgatctatatttaaaaagcttaccccattcgaaagtataaacgtaaaaggaatcaaaattgtaaacgactaaacacctggtctttcctcccccaatggccacgaagctattgtcgctcacatgcatacgcaaagagagattcagcggccgttaccctcctgtgctgcggaaacatctaaacagcaggccacgcggcggcggagatggatcaccgtcggagacggcggtgcttaagatcgacgaggaggaggcggtctccgatgcggttttccgcgtcacggggatgacatgctccgcgtgcgctggatctatcgagaaagagatcaagcgtcttcccgggattcacgaagcggtcatcgacgctctcaacaaccgggctcaaatccagttctaccctacctctgtcgatgtaagtttttttcttttttttttttgattggaaattcaatatctgcttctttttattgttatatcggaatcgatcaagttgcgtatctcttggttgatgcacttcctgaacctacatgataacgtgtttttatttactgtggtaaattaggataataggtttcgttatctattttaatctggattgttgtactgattgggtaggtggagacgattcgtgagactattgaagatgctggatttgaagcatcactgatagaaaacgaggcgaatgagaggtccagacaagtatgcaggataagaataaacggtatgacttgtacctcatgttcttcatccattgaaagcgtactgcaatcactttacggtgtacaaagagctcatgttgccttagcaattgaagaagctgaagttcattatgatcccacgctcctgagctacgataaactactggaagagatagataatgctggatttgaagcgattcttataagcacaggcgaagatgtgagcaagattgatttgaagatcgatggcgagtttactgatgaagcaatgacgatgattgaaagatcgcttgaagcacttcctggggttcagagtgttgagatcagccatggaagtgataagatatctgtgttgtacaaacctgatgtgacggggccgaggaacttcattcgtgtgatagagtctactgtctttggtcatagtggtcacatcaaggcaacagtattctccgagggaggggtgggcagagagtctcaaaagcaagaagagatcaagcagtactataagtcgtttctctggagtttggtttttacggtaccagtgtttttgacagccatggtctttatgtatatccctggaattaaacatttgctaatgtttaaggtcatcaatatgctcaccgttggagaaatcataaggtgggttttggctacacctgtacagtttatcatcggctggagattctatgttggctcttacaaggctttacgccgaggatcagctaacatggatgttctgattgctctgggaacaaatgcagcttatttctattcgttatacacagtgttgagagctgcaacatctcctgatttcaagggagtagatttctttgagactagtgccatgctcatttcgtttatcatactaggaaagtatctggagataatggcaaaaggcaaaacatctcaagcgatcgcaaagcttatgaacttggcaccagacactgcgatattgttgactgtggacgaggaagggaatgtgactggtgaagaagagattgatggccgattgatacagaagaacgacgtgatcaagatcgttcctggtgctaaagtagcttccgatggttatgttatatggggacaaagtcatgtgaatgaaagtatgataactggagaggcaaggccagtggcaaagagaaagggtgatactgttataggaggcacactgaacgagaacggtgttctgcatattaaggtgacaagggttggttcagagagtgctcttgcacagattgttcgacttgttgaatccgcccagctagccaaagctccagttcagaagttggctgatcggatatccaagttctttgttcctctggtgagtagtattcttgtcggttgaaattcaagtttagtcttttaaaggcacaactacttcttaaacttacgaattataatattgcaggtaattttcctatcgttctcaacttggcttgcctggttcttagctggaaaactgcattggtaccctgaatcatggataccttcttcaatggatagctttgagctagctcttcagtttggaatctctgtcatggtcatagcttgtccatgtgctcttgggctggctactccaaccgctgttatggttggaactggggttggtgcatcccaaggtgtgctgataaagggtggtcaagctctagaaagagcacacaaggttgagcctcttgcattgtaacttattatattatatatgattgttctgtaccattttgattttttttcagatgatgaaacctaacagatcgaatgaatgtgtaggtaaattgcattgtatttgacaagacaggaactctcacgatggggaaacccgttgttgttaaaaccaaactcctgaaaaacatggtacttcgagaattctatgaacttgtggctgcaactgaggtaatctcttgtaactatcaaacacatatacaaactcgtggcatgcctcaaaagtttgatctctacgatgtcactatctttttatcaggtaaacagcgagcatccattggcaaaggccattgttgaatatgcaaagaaattcagagatgacgaagagaaccctacgtggcctgaagcccgtgattttgtgtctatcactggaaccggagtgagagcgactgttaaaggaagagagattatggtgggaaacaagagcctcatgtctggttacaaagttactattacagccgatgctgaggagttgctagcagaagctgaagagatggcccagacaggaattctcgtgtctatagacaatgagttaactggagttctagctgtttcggatcctgtaaaaccgagtgctcgagaagccatctcaattctaaaatccatgaatatcaaaagcatcatggtaacaggtgacaactggggaactgcaaactccattgctagagaagtcggtatcgactctgttatcgcagaagctaaacccgagcagaaagcagagaaaatcaaggaactacaggtatgtagtacctccagagtaaatatcttttaaaatataagattgaaaatgatagaaacaatgattctgtaggctgcgggtcatgttgtggcgatggttggagacggagtcaatgactcacctgctctcgtggcagcggatgtaggaatggccattggtgcaggaaccgacattgcaatagaagcagctgatattgtcctgatgaaaagcaacttggaagatgtgatcacagccattgatctatcgaggaaaacgttctcaaggatccgtctcaactacgtatgggctctcgggtataacctcatgggcataccgatcgctgcgggggtgcttttcccgtctactcggttcaggttgcctccgtggattgcaggtgctgcaatggctgcttcttctgtcagtgttgtgtgttgctctctcttgttgaagaactacaaacgtcctaagaggcttgatagcctggcgatccgtgaggttcaagtggagcgggtttagaaaaccaaactaaaccgatccgaacagattacttggttgtgtgatttgatgaactgtatgatttgttacgttagcataataagaaatttcacatgattggttcaatggttctcaggatggttcctgataatatttacctagcacaaaagatgatgctttatcgtattcttcttctagaatactggaaaagaaatgtcacaagcaaactaagaatgcatgccgttcaaatctagaaaaacgctccacactgacaagggagagtaaccttatatcatttgagaataaaaaaatacataaatctgatttgaccaaaaaaaaaaaaaaatacataaatctgacttgtgggttatgacggcagatgctgagaaatggtccgagatttgtttctttactcgtgtcctttggatgcattttatttgaagatgatgctttagttttacgcatcaggcgcaataaagctgaaataataagcaaccgcaacggcccatcattaaaagccactcgcattaacagcgcgtgaggacggataggccagagcagagactgcatttttcatgccttttagctttctctcttttgtcctcctagcagctgactcttctctctcatttctcgtgcttctcaaattctacttctatggcgacgaaagacccagaatctgtttacgatataagcatcgaggtgacaattgcttaacttcaatcaacactctttaataatagaaaaaaatgtttgtgtgtttttgctaaaaggaatgatctttggtttaggtttttttttagtgtgtaaaaaagagatccatgaatggttagcttcttcttgtttttctcaagaaagaaagactattactttgaacttaagatgtattaccctctttttttttgttgttttaaagtgcaagtctttatctaaataatcgctatatctcttcttcttgtttttcttggaacaggatgcaaatggaaacagcttagaactcagtcaatacaaagacaaagttcttctaattgtcaatgtcgcttccaaatggttaagctttcttttacacacacacacctcttagctataaacttccattattgtaattttgatgctaaacgtttgtttctgatggtctcagtgggatgacgaactctaactacactgaattgaatgagctttacaacaagtacaaagacaaaggtaaaaaactggtttcaaccaaaaatcactcaaagtctctttgtttcttcccagctgattagcttttttcaaagacttgatgttttgtttctgctgcaaggtctggagattctagcatttccttgtaaccaatttggtgaagaggaacctggaactactgaccaaattacagagtttgtctgtacccgcttcaaatctgagttccccattttcaacaaggtaaagaacatgaattggttgcaagttgtattgatgttgaatctttctccgttgtgtgtttttagattgaagtgaacggagagaatgcttcccctctttataagttcttgaaaaaaggcaaatggggaatcttcggggacgagattcagtggaactttgccaagtttcttgttgacaagaatggtcaagctgttgaacgttactacccaactacttctcctcttacactagaggtaatgaaaccgtctctttccgtctctgaagtcctgattcctgaacactttttttactctctttgtgcttatgttatgtcctcttgtttttttctgcagcatgacatcaagaagcttctgaacctctcatgaatggtggtgttatccgattcactctgttgataactctactttggtcgtgactcgtgaacttgtcatgtaataaagcaaaatcacatttgactttggttccaatttgttctgtttacgtttcacaaatccaaaccggttgcactcagtgactcacggttaatcaagtttagtaaaacaagcattacctcatcataatacacaaaaaatgttttagtaaatcaactttagtaaaataaaatacttattaatgtgttggtttctataagggaggaagaactgaataaatactcacggttaagacctctctactgatgaaaaccaggtttcttggtgacgaccacaaagaaagagagagagagctttatgggatagctaaagttaaacatctccttaaataataacctgaagaaaggggtctagctagttgctacattaacaatgttacaaggaacacagagatctgtctcaattctccgagatttctggttttaacattctcagataaaatctacaacaacaaagaagatatttacagcattcacattctgcacgtatgctgctgctgctgctgctgcttcaatagctaagaaggtagtaaaataggaagaaagattaaatactgtctcgttctgaatcatccgcgagtcaagtcaatatcagtgagtaggtttcttccgctagtagagtcaagtgatctgcctgagactgagactgaaccttcccctgaaccgggccatccactcattccctgacctgagaagttctgtggcgtctcctgacccacctgtgcttcttcttcttcttcttcttcttgtggattagtctccatttcgctatccttgtgctcttcctttggtttattttcttgtttgatagtcttgttactgttattaactcctccgtatataaaactacaagccacaaccttcaaacaacaacaaaacatgttttttttatttctgttaagagacattacaaacaagaaaccaaactcataataccacatgaaaccaataaagaagaggaagaattgagaaacctgaacgaggctggctgcaataagcattccaatcccaccgccaataacatgaccttcaggaccagaaagggagacactcaaaccgcctgttcggcttttggatccaccttcttcattcaccaaataagatccccctagacttagtatctcaaaacgtccctaacaacaacaacacaaggtgattgatataaagaacttcattagtttcctcttgttttgagtttcttcagttaacagaatgaaacgatttttgaaaaacctcatatgtcaaagaagactctgttgtagcgggttgacgtagagtgactgaagaaactgttccggtgcctgacattatacaaagagctcgaggtctttgctgtgagaatgacatgacttttgaaacgatatcctgcgagaaaaataaaagaaaacagatacagaatcttaatatattaaatccataaatatattattagattgaaatgattttttatttttttctggagagcttacttctcctgctccaacactgatgacatgaggtgcaaaagcaagtccagctgaagtgttcatccactcacctaatgtaatcaacagaggtaaaagattgctcttaaattaaaatttatattgaagactaatcacatttcaatgacccattacttagctatacacagattataacacacatggatcacttaaaattactttttccacagcttaatacctaacaagcaacgttctgtaggaattacaacatatccaaatcaaaccaaactaatttgtttcagcttaagattttttttcactaattactaatctaaacaaaagtagagattagaccacacacttggatcattaaattatcagtaacagcagagctaaaccaacatagtctgtcttaatttggccacacaatcatctatataccttctaagcatcactggactttcacataaccatacatctaaactcaagttcttcacagtgtaacattgaaaaaaaacacttgagatctcaccaagattagctaaacgttgcttccttccagtaccaggaggtcgacctctggctcgtttaggagcatttggatcagtcactgcagaagagtccttagctgctttactactaccaccagaagaacaaggcacaggagaaagccctaaagagacttgtccatcaggaggagcgtacttcctcggccgtccacgcttcttcttaaccaacggctgctccatctgtggcggctgcagcggctgcacagaagcagaggaagccatccccatgtgaatgttgtgtccgaaatcagagtgtctgtggtcggccatggagaaatgaggacccgggttgttagcttgaggatgatgaacgttagggttcggcataggtctcattcccggcggcggcggcgcgtggagaccactcgcgacctgggaaggggagagattggtgaaggctcctctttggaggtagtagtgaggaaatgacattgcttctctcccgtccatgcatttaaatgccttaaattacaagtcttttcaaatgggttttgagccttttagatgaaacattgagactttatgaagaagagagtaggaactacccagaaatagtaaaccctaattccccaaattagtaaagagaacaacaatggcggatttttttttttttgtgaaacctataaagaaggaagctaaaaatcttgagctgttactagtactgttagtctaggagagaaaggaaatctcaagagaagagaaaagagagagagatttgatttcgaaatctagggtttccgagatgataaaaacgcaaatgtacatcagaggagaccagggaagatgacagaagagaagagaacagaaaagagagaagaaagagagagaggtttatacagtagtttttgattttttttaaataattgtgaagagagagaatgaaattttaggccttgtctgaaagttagaagactgaagaagaagcgaggaaggagagagagtgacggactgacgaccactattttttttcctttatatattttaaaattattttttattcaaacaaaactattaaacggttttaataatattaaattgacttgttttaagaatagttttattcaaaagcttttgtactttccgttttttatagttgaatttaatgtctggaataatgcatatacctctcactaaaaatgtaatttagtcagatatatatattaatgcctttcatgtataaattatagtatgctttttaactttttttattctcatgaaaatggtatgctcatctcaggttaacaatatttacacaattaaaataaaagtaattggcatgaaaaataaataataatttacaaatttgcaaaatagaactttagtggaattgaggggtagatctagtccgtttggtgacaagttgacgtgaacacccttatcaatctgttggctgagaaatagaaaccaagagttgaattatgatcccatcagtataatcacaaattatccacataaaagctaaaagaagactcatccacagtcatgactatactctatcaaacataatcataaactcatcaaaaaattagaaactataaaaataaataccaactaacatataaaattatctggataagttatatatagaatgatataaaacatatgtatcacgatgcagtctaccctattcggatatataagtaatacagtattatactaattatctggttatttttatggttgttggttatttaagttagtggtcagtcagattttgaatgaatagtgaacttgatacttacctttatattataaatcataaactttaaactcaaaagataaacttcaaatcttaaatctaatagataaaccataaaccaaatgctaaacatcaatcataaacataaatgataaaccttgaacctaaaagatcaagcttaaattttggataaaccctaaattcaaattaatagagtaaccattaatcctacaccttaaacagcaacatgcaaactttatctttagagtaatataaattcaaaacaataaatcattttatataatactaagttaactatatggtcaacattgctttagacttgttaaaaacatctatattttactaattagatttttcggtatcaataaattaagctgtgtataccagttattcggatatcattattatcaacaagtatttacatcataaacatatagccgaaaattacattataatctggaatcataaaattatttaagggaatgctatataatcttttcatgagatacaaaaatgaagtttctatttcaatcattaaatatatatatatatatatatatatatatatatatatatatgtatctcaagatttttccggtcatcgtcttcaacacttgatttctactaggcatgggtattcggggtcctaatcgggtttcggttttatccattcagatttcggtttttcgggtttatcaaaaccagccctattcggattatttgaaagttcggttcgggaccggttcgggttttatcgggttcgggtcggggttagtaaatcttcaaagaaccggtataatccaatgtactttcggaagttcgggtcccaatcgattattcagtttaaaaatatctgatttgtacctactttgtaactaaaacataagtaaaatcgattttttgggtttcaaatacctaatttgaacatttttgtaaccaaaaacataagtataatcgatttaaaaataagaaatgaacatcaaccatgatcatttaaaatcaaatgaaaatgaaatatagttattgataaaaagaaaagcaaataaatgaaaacataaaatgaaaaccgcgttctcatgaaatgtaaaacattgtttaatgaaaacaaaatctaaatctaaatatttaaaaattcaacagccacatttaaccatcaaccttcatgtaatagaatcatcaacattcatgtaatagataagtattttatatgttcagtatatcttaatgtattttgaatacatattaggaattgagatcatgtttgatacaagatatttctagggttttgaatgtttcgggttctatcggatatccatttagtttcgggttcggtacggataatacccataacccgaaataccatgaaacaagatccattcggtatttatgtcgggttcggatcggttcggattcatttttatcggatcgggttcggttcgaattttcggattcggtttatttgcccagccctaatttctaccattctaaactccaagaaaatgttctatattgttctttttgttcatgtcaagagatctattaatagctgtgctgactgctgagtaaatcgtatgtatcattaattgattggagtttgttctattcatgtctttccggcatgaacaacaaaatattacacaatcttaattaagtaaaatttttagtcgaaataattactttaatgtattaacaactagtttttagtggccagcaagcacatctctaatatattatttcatttcttactctaaaacggtgtaaaccaaaaatagaattgaatttattccaatgtattactttattttttactttaaaaatgaatactctcaaaataattccatttttatttaattaataatttttagtaataccctcacttataaaaattatcaattaactccaattattttatgtttacaaaaatttcataaaatataatttatttaacttaaatatttattattaaaatacaataatcataaatatatataagatatatagacattctggttcaataatgaacattagaatatattttccacaaatggttaactaatacattttaaaatgaataacaagttttttatctttgattttcctaaatcagggaaaaaatatgaaatcggtcatttttatcgttcggacaatacttcattgattttagcggttccataaatgatttaggagattatacttattttatttattttatatttttatgtttagttttggtatttttattagtttatacatctttatttaaattattaaataatttcttatgaaaataatatttttcatgttattgtatatttttaaatattgaagtattaaataaaaataaggaaaatatgaaataaaaatatttaaaatttaaaagactattttgtaaataaataaaatcaactctaaatagaataatgaataaaattactctatatatagatagagtaacctttgaaaattgagtgagatttaagtatattttatttaaaaaagatgtttaaaatagaaaatggaataggatcaaagatgtcccctgatacattcgtgtgtttttttcgtcaaacacctagtatgctcttattgcaagatttaaaaacagaaaacaaagcgacttttattttggttcttgattaaaaagagggtgccatgagagagatgtcttgttgactaaagagaggagagggaagcggacctacttgaaaagagccaagaagagagaggatatctctctttctctctcacatgtctgaatcactttgctatttctttctttgcttcggacagtgagcctcctttcctaactttatttgttttcactttttatattcgcccttttcatttaattttttattaaaagtctttttttatttctctcaatatttcttttgaaaatgattcaagaaaatatttatactatatgagttccacacttccacctaaattgaaagcttgtatgatgcatttattgcatttaatatccggtggctaaagagttccgaccaataaaatccaatttgtcaacattttgtaatttgtactatatatttatatagtctttttttttgtttttttatatagtctttttagattttgttttgctaattttccatcctctatttatatcctctaatttctttttttttccattttagaattaatatgcggtccttaatctttgcacttaacttgttttgtcaacaatccctacagtcagttatggcaaaattatggtgtcaaattacacggcttcaacgcttatttaatttggctttttgacaatgaaataaaataaatttgactttccattctcacctttttgcgtaactttcacctaaacttagtaacttgtccattttataaactaccgattttgatgaaaagatcgcataaatatatttgaggccgaacactactgaacttgccaaaaaaattatatattctcacataaatggccataaacatacttaaatgtgtccatataacatttttgctagttcaagagagcaaaactatatcagaaagtatttctcagaaaaaaaaattatagaagactgtgaatcacaataaatgtagatttactaaaagtggaagaagagtgttcaaagaggttttcattttgaggatggtgtctgccaaaggtacaacaaggctttatttctaagaaattgccgtagttaataatgtgtttcacaatacgtatatatacatagagagagagagattatgtactattataatagtgggtctgtgaaacatgacgtcattaatagtgtgtctttcttgtaaggaaagtgatctcaactgttgcttttttattttccttctgatgtattttgtggggataagagagatatgattctcttcacaattcttttgtggtccggatatttctggtccagtagtttcaaatttctactagctgctggtagtttggtgttgctctagtttttttctgaggtttgaaatgtgaaacaaacaacaaccaaatcatgatacattgaactgaagtttgtatatttattctttgtgttcactcttctttttttgcattttacaaataaaactgttgaaacttaaaactagtattccaacgatctttcaattaacggtttagtaacaaaaatcttgtcacgacaacaaaagactttacatgacataaaagtccataaactgattattacccaaaaaaacaggctagcaagatatttgatttcgaaacattaaatatgtagtatatttggttcgactggtgcgtacattagatttaatcgttatattcaagttaatctggtaaattttatagtctaaaagcttttatgttctccattccaatggaaacattacaaaaaaagaattgacttgagaaaaactatttaaaattgaatgaataaattaaattgatttatatttcagtgtttattttggttctcgagtgaaaaaccagggaaggatatgaacctgaagacaccgtttagctacccttttgatgcgtttacggcttttccactgcaaatcaccaactgctgcaccggtcactaccctccttgcccgtctatggtcaagtgacggtgtctttggctccattgatctgttaacatagatcaatcaaacaaatggattctgagaaatgggaagaagcgatcaggtaaagtatctcattctcttttttttatacgtttccatggcaggacttaggtttatgccaataataaactccacagaacccacatgaaaagtagctttgatggtgacttaaactaccgaatgaagcaaatgtatagaggctacaagagagtacgcacgaataaaagtttgtgccaatgtttttggatggtaaagaaacaaacctggagggatcgttttttggagaggattctgccggaggacagcaagcgaagcagacataagcctcaggccgccagtgaagtttaacacaataggtgtgataccattcgccacattgactacaagaaaccatgaatcttgagttgtatggcttcaggcaaacgcagtgcaacatacttcgagctcgtaatgcctgcatcaaatcaaaccataataatacaaacagttttagataaacagtaaaggttgtgttgtgcttgttaacgctcatatcttgctaacctgaagttcttcctctgcaatgacgggcaaattttcaccctcagagataagctcgaatacatcttccaaggcaagagcacccgagtctgtcaccacctggagacaaaaccaataactctcgttaagcaattccaaagtggtagcaagcaatataatgagaaaccgtgggtgtgggttggtcatgtacttttctagctcgttttgcccactcttgtccagtgtcttttagctccacaagtctcttgcctaagtgatactcttcaggtaatattttcagtgtttgtccctgtcaagaagcacataacccaaactcatcaaccagatcattgtggtgctctttattgaaataaggtatctctcactaagcgcaggaagttgatattattatcagaacataccgcttctaagtgctgctgaattttctgtaacgagggctttcctagatcttctggtatctgcaattttaagacgagcttaaacgatcagaaaggggtttgtaaccacaattacatcttgaacacaagtatcaaaaccaattaattaaaattcaataccctattttgtacctcaggggaaggtgaactagagcctaacaagatggtcttataacaccatcctagttttaaacttgccgtttgaagtttgggaagttcttccaaattaagaccaagggacagaccagatgttctggcgcagtccactctggttatcaagtccataatcttcggaagaatcgtgctatgcttgccatcatctgttttcgcagtgtccaacaaatcttcagtttcttgcaagagcgggtgattatcacactgccacctctcgcaactaagcagtaatgtttcaagaatccttggctcttcaagttgaacaccaagcgatttagactgagcaaccaggtcctgcgaaaatcaaaacattgaacactctataatcacatgttacagaaaacagaaattccacaggaggcagacaaacctttaacacaggaagttcaagcagagaacacggagatgaggcagtagaggaaacggcagataaaaagggctcagaattctgaagccaagtttcagccaacgaaatggtgttctctatgcctttcagagagggtaaaacggcaccaatgttgacagacatcctacgaacatcatctttttgatgaacaaaagacttgagaaatactaagcatgggctgggttaagaaaacatactgtacgagttctttaaggtcggacatctgagtttcactggcaagaatactgcttgctctttcctcccaaaacctcgctgtagacaaagttccggcgatctcaacaaacagcttctcctcttcgatttgtagtctggaaatagaaagtcttggcatgaaattataatggagtaggatgcatattacatattctaaaatcaaatattagtggacgacgtacacaacagcttccgagagcagctgctcaatgaaatccagagacgatcttgcagcataaacctacatcgatatgacaagctgcatcaaagatatgaaccacagaaagagcactcggaacatgaaacctaatgctatttcattatataaaacaaatttccatgcattttacattcaacacaaaatgaaagaatgcgaactatcacaaatagtattttaaatatcttgataattgctggagaccaataagaggcaaattcaaaaataattagagaaaacatttaccgtttgtgctttttcacgacaagatgccttcttcaattcaacctcaacaagagggagcccttcaactatttcagatactgtggttagtgttaagctatgcgtatgcaagtatgcattgcaacgcaaaaataggtgggaacaagttaagagacagtaaaaagagtgtcaaggattagaagtaagaccttgaatgcctaaggatgctccatcctggagaagggaactcaggtcactgattagctttcgttggtccttgccttcacgaacatcagccattgtatcatcaaagcgtgaaatccaagacaaagcatcaacatggtactgcctcaggatattcagctcacgaatgttaatgctacaaaggccatcgaattcatgaaccaaatcttctacattctgtaaacaaaagaaacgagtgacttcagaatgattcgacaaaagtgcatgttgttattcacacttaaagatacagaacaaaagtacagccaaccttgagagatataaaaccactcaaaactttgctacatttatcacgggctagttctgatttctttagcaaatccaggatcccttctgtttctgtaagcgtcacctgaagctccaatatctattaagggaaaagaacgattagaacacatgaacaagtgacatagtgatcatttttagaataatgatgataatagtctacctctgactttagcttgaaaagttcatccaactcaattccaggaggttttgaagcggcaagatagcatctcgcccttttagctaacatctgccgacccatgaagaaaataatttatcaaattcaagaaagggcaagaaatgaaagcgaacctggaaaatcgaaaccactagaataggagtatgctcgtaaactttgaaaggagaaaagaggcaaatacatctagattcaatatggcgtcagtctctcaaagaccttcgtggatatgtaggtataagaaaaatacgtcctagatacccttcaaaattagcaaggattgaagaaaatatatctcatatttaatccaatatgcaatatttatatactccttttgactcaaacaccccataatagaaactgcgagctagatgaaaaaatgactataaatatgtctgtccgaaccatggtttaccttcgcggaagatattttctttgacaagatcttgtgtttacttagggagactggtgaactggaaacttcggaatgcaatagctccatctgggcgatctacaaggaaaaacgggtaacactaatcagaaagcataacttgaatgattttactggatttggtcagagtgaactatcgtggggaagttttgtagtggcataccgttgggctacttgacagagaacaatcgattttctcagacaacttcctagcctcttcagcaaagtcctacaaagaaatggaaatgctcaattgataacataatgacttacaacgctaccaatccaaaaggaaaactggaacctttcaggtacatagactaacctttaatttaagataaccagactgaaagcaaggaacggggtcaactttcagcaactcatcgatgaactccaagtgaactttctctgtatcattgttgcctttgccttcgacttttgaaagacagtcgccaacagcttcagcccatatctttgctttgatcaaactttttgcaacatcccgtacctgtgtgacaaatagaaaaaaaaagtttttttccataatccacccaatgagatatatacaaaatctttccaacagatactcaaaactcacgcggttcatttctgatccaccccaaagaaactgttctgcttcctttaaaagagtggcatatacatcactggaaaagacatcctggagaacctttgatgctcgacgaagccaatcttcagctggtcgtgcctggcaaacttgcatcccctcctgctagtaaaagaaaagacagcaatattaataaactgtaataagattcaaggccaagcaaccaaatatgatatatacaaaaatctaggttgagacatgtttggacattaatatataaagggaaggctcctagttttttttttttttttttggaactgctcctagttatttaatactagactttatcaaatccttaaatacggatgaagaatggcgatgctgccgctcatataaagtccaatatggaaaacaaaaaaaaatccgtattgttatttgcaagtaagtataaaactacctttttgttagaagcacctgaccgtttggtgcctgaactcggccgttgtgaatttttggtttcttgagttttgcagtcaccaaacttttcaacttcttgtaccattccatgcaactcggcaagggtataccgatataccaggcgcagttttgtaggttcacattcacaaaggtgcttccagtgctgaattcaaaattataaaaacttacagaaaatcgagacaagaaaatcttaagaaaaatctgcctacagtaacgcacctttagaaccctcaacagttctatctacaaaaaaggctagccaagttgatccccctctaagaagttagatatagatatttacctccaagcatgcaaaaacagatggcctgcagctgcagacgatagcagaaagatggagaaactgctggcagatgatgcatgttgtatcctacaaataccattataaatggtccacacgtcggagtattgtcttatgaaagctaacatgaaagagtggacaagcttaacatcaaaaccaacaatatctgattgcagaaagaaaaaacctcttcgatgcccacagaatcagggcattcaggtagaaacataggagaggatctcaaaataccacttttccaaagctgctctctcaaagttttttccttgctatatattctgagcagttctttcttcaaatatattgatcctttgccatcgcagctgtttccctataagtaaaagacaattaaaacaatcatctacatttgttgcttgaagctagcatacacaattccactagtaaccaatgtcaaattactagtagatactcccgtgatgcctcttttaatgtagctatcttcagtaccccactatcccatttgatcaagggtaccaatattaagtaattctagaacaaaattttctttcgtaaatgcaaaagatatatagaccatttaatcaaccaaaaccaacaaacacatactatctcttcaccttagctaccacacagagaagctcttcatgagatatgactgcaggtttacggtacagcctatacagctccgcaccataaccaccataaggtagccaatcggcagtggcaaaattgacggcctctgcacaattcaaacctgataggacagcacatgaaagtttatcttaaactgcataatgacaatttgatgggaacactttaacttagattagagttggcgtaccgaaattgaatccagcatgaaaggattttggaaacgtgatcacaaagtttccaggctcctagcagtgagaacaagaacataaattatgttggaatacttttaggaataaagttattattaatcataaacttgtaaatgcactagaaatgctaacaaccaaatgaactatatacttgtataccaaacctgtaatactgtgtacacagggactttattttcttgcaaaacagccggactcaacatagtaaccagttgaaagagcaaatctggctgagcatcaaagagatcaggtagggcttttcgcatgacctacagaaaaatcacgcagcacaagcaccttaacttttctttctgaaagtgagcaaatattgtagtatgccagaagaaatatattccaaagaaggaaaaggaactgatactgggccgtgaataactagccaaagattagttacaatctggagcacacaaataaaacaaaccttttcaaaagcactagcagcactgcctggaacaccataccaacattttgcttctcccctgaaatgtagaatcaaaaagaaaacaattaagagacttattatgagtgaaatgtttctttatgacaaaataaggtattaagcaaggtgtctttgcgacttccaagaactcaaaaataacaaaagaagaagatgacgattacagtacaggcacataccagtggtgataattcacagagtaaaaacaatggtcctcaaaatgccaacaaaaagcagagaagagcattccaagatatagccaaggcactgtaacaccattgatgttatgccgaatggcctgaagcatagatcctttcaacttaggcatgttattgagattccaagggctatggcaatattcatcccaaacatttgcctcaactgattctggtcttctatcacctattctaggaaaaccactcccgtaaacagaagtatccaagtcattaccatacataacttcaacgtcaccacctgacccttctactatttcccaaaacttcttctcaatctgcgtcctagacaccggccctgaaccaaaccacttccttttggcgcgatcagcaatccgcttgaaatcttcaagtagcaaacatttacccggcacaaagccaaaagtgtcttcatcagtgtttaagcaatcaaggcaataccagttcccaggcgggatatgcttcaacggcggcgagagacagtatatatgccaacctttattacaactatcacacaagagcatcacttcaccatgtttgtcacttttgcactgctcacatgcctgatcaacctcttcttcttcactttccaccttatgatttttctcgccattatttcttttccttctcttcgagctagagaactcagaacaccgtcgattccttttgtgaccctttgcagaaggatccgcactcatcatcccgtgatacttctcaaactcatgcaaatgctctttatacaactgacacaaaacatgcttagcacacttggagatcttctcaccagagctcataaactgataaacctcaccccatttcttccccttgacaaccttatcataacccccaaacctcttcaccgcgttaaacaccttacacagatccaaatcacccccttcaaaaaccaccctcttcttcaccttcttccccaaacgctcctccacaaacctcccgtactccagctgaaacgtcttggagttgcaagaagcgggacggaactgcaaccggtgaatctcctgcgtctttgtcggaaacctgacagactccaagtccaaaccgaaaggcggtttccagcttttcggtggaacaatcttgcagatcccgtaagcctctgcctcgggcttgatcttgtgtatgtaatctagagggcttttgaattcgtcttcggtcgggtaataaaccggtccagacgggacattgaccgatcctctcagcttctgatctaaaacccttttctctactgccttagctctaccttttcccattaccaccaaacacaatccactatcataacctatggaacaattcaattttgatcacaaaccctagagagattaatccaagaagagtgagcgtgaatccaattctagggttttagcgatttaccttgtgagagagagggatagagagagacaagtagtgcaaggaatctttggtttgtgaagaaagattttgagaatttttaataaaatatatatcgtttctttataaaggaagattcacttaattcaatttccgaaattgggttttcttagtaacggatattacggaacgggggaggagaagggaagccaaacgcttctcagttcgtgtttatggaaagaaaaactttgtgccggttttgttatcaagtactgcatgccgtttatattgaaacaagctgtacaccgtgtagtttcgttttactcgctatagtgggttttctttcttggccctgaatgttgaaggcggctttgttaggcccagaagatgattaagctaattagctaaactagttttttttcgacaataagcttttttatttatcgtgacaaaaaaaaagcttttttatttatttattattattatcatcatcttttccgacaataagctaaagggtacaaattcagagttcttcacatacgaaatcttgttgaactatataagtgatcttaaactacaaaacttttttttgaaaagtgactttctaaaactatctgaatttcttaaatgaacctttacattttatttacatgtaagatttgatagaaaacaaaagtttcaagaaaataaggaaaagttgtatgttttcaaggtaagaagaaacaaataaaacagtaaaaatattattgatattgctcgcagcctcgcaggtaaatgatgtgatggtcggttaaaaggcgttcatactgttcaaaaaattattggagcgttatgtcggtggcaattagaaaccttaaatttaccatactttttgtatcaataaatacctttttaattttattaattaacacgataattaatatcggttacgaatttggttcgaacaaaatggtctaattaaaaaaaactaacaaaattcgctcatccaccatactaccatattccgctaaagaaaatgatagactatcgatcttcgttttctactattgtagattaccacgagaagatgaagtttacctcgtttcttcggtttttggaacatcatgtggcatcatgtgtcatcaccggagtatctggtttatgatgatctcccaagcttatcgtctctactgattatgaagtcaaatgtgtgctggtggttctaattaacacagtcaagtgtgtgttgtggttctcattaacacagtggcaagtcttgagaccttgtatggaggtgggatgatacgggtttgtgtaggtttcatgagtagatttgacagccggtcgtcaatggtcttttagtggcttctcgatgtgattcctagcttcgtatctcctctatgctgcttccttccccattacatccgatagaacgaaggtgacggctttcttgatcagagtgtcacttctagtttttcatcgttgatatgtctctatcgactacggctcaaattattgttcttcgattctcgaaggcttcaagtgttgtagcgattcttgggtgcagccgtagatcgtcatggtgtcgctcttggtctatgctcacatcccatcgcctcacgagttccctattatgtggtggtgtagcttaacttttatatgcaggtttagaggcttaatattaggaagtggcgatgtttcaatatgtttcttgcattgttcaatgtggctatggtgagtgtatagtttggaccgatgcttctcttataataattgatctttgaatttcttctttattgtcgtgtgcacttaaaaagtggtttagattacaagattggataagatctttgggatccatctatcccaaaaccatcatgagaagtctggacatctgaagtaacaatgtgaatttcatatttttgtcgttgaaggttgagaacagtgacggattctcgaagattatcagtccaatttaataaaacacgtcgaataataagtcgaacaaagctaaagctttcaggggatgagagtcctttcctcgaattcagaagtgaagggcttccccgcggttatgagaatttctggaccgctttcactttctgttcagcattagtaaaagtttaatttgagaatttttgttcggttcaacgcttgtaatcaaaaactttatttctttttgagtcttatttataaaaatctactatattaatttagagtgctaaaatttatctaccatttagaagtagtcattttaatttggacattctctagaatagtaggtgtttggctacttaaatctgtttggttccttgaatatatcaacatgtctaacaacttaatttaaaccaacataaatacacattataaattgtttaactaatgggctttggaaaattattaaaattgtgttgctttacaaattaaagaccatacgattatgtaaaccaatttaccttaggccttataaatattaggttttaaccaactaacattttatttgaaacttaaaaataaaagactatataatatatccacaaacaatattataataaaaacacattatttttatgggattaaagtttatttgattttttcgttttctcagtaacaattaaaagcattgtctaaatattttacctataaattttgaatctcacacatattaacgtttatatacagtataaactctttgaattaatactctataaattaatatacactaattttttttaataaatattataactttatagtctcaacattgaatttttggttcaattattatatcgataaattaataacctctataaattaattttttttatagttttggtgtagtcccaaacattattaatttatagaggtttcactgtacaagttttaatttaaaaaatgtgtatattttataaccaaaaacaatattattcaaaaactatatatataaaaactattgttttttataatttgtatattctaatctcggtaacaattagaaaagtttgtttaaataatttccgcccttgaaaagggcgggtcagtatctagttttaatttaaaagaaaagaaacagaaagattaatggttggtagtagtgtgtgatagcaaaaatgagttgttcttagttttcttaggacccataagtgagttgacttggtgaggagaggagaggcctgctgcctctgctttgctgttcctctcttacatatacactaacccccaaaacacacgaaaatataaagttttttaatttttaactttctggcaaagttgtctgcttttgtgttcccacaaaaaggatagaaagttttaggttcttgagctttctctctcgagctaaacacccacacgagcgcctcgattcctcatttccaacttttttcacatttattctctcttctcttctttcctctctgctttacttttaatttccaccgatccgttttctcgattctgacccccttttttcgcatcgttttgttaagttgaagaacattacaagaactgtgttttgtctgatctgttaatttctttttcctaagctctgaaaagaaattcaacgcggttttgatctggtcaaggtctcgattgagataaaaatcagcagttttttagggaggggtttatggtttgactgaaacacttgattaaaatgggttgtgaagtttccaagctatgtacattctgttgcctttcagagcctcaagaatccaatcgtggactcaccagctctggtaataaaaaaacttatagctctgatcatttagtttttaccctttttgttgttttaatcgtggatttgttttttttctttctctctcaggtggtgatgataggataggtggtgaagggaacgatgtgcctcagtttcgtgaattctctatagagacgctaaggaacgctacgtcagggttttctacagagaatatagtatcagagcatggtgagaaagctcccaatgttgtctacaaagggaagttggataatcagagacgtatcgctgtcaagaggtttaacaggaaagcttggcctgattctcgtcagttcctggtaactaactatctttgtttgcttaataataaagctcttacctttatatgcaatcttggttcctgaatctctttggtttcttttgacaataggaggaagctaaagctgttggtcagttaaggaactataggatggctaatctgcttggatgttgttatgaaggtgaagagagacttcttgttgctgagtttatgcctaatgaaactttggctaagcatcttttccactgtgagaatcatctctctcttctctctttacatgaagcttgtcttgtgtctcagtatgtaagacagatacttttgatatgtttcaggggagtcacaaccgatgaagtgggcaatgagactaagagtagctttacatattgctcaagctttggagtactgtacaggcaaagggcgtgcactctaccatgaccttaatgcttatagagttctctttgatgatgtaagttaaaggttatatgtttgtttgtttttgcttctttccttgttgatgtgtgcattataaaattcataatatggtttctctttgtttaggactcgaatccaaggctttcttgctttggtctgatgaaaaatagtagggatggtaagagttatagtaccaacctggctttcactcctcctgagtatctcagaacaggtatatatacttaaccacttgcatatcagtttgctttatttgtactgtggctaagtttttttctgacataatagtttttgtgtgtgttgtgtctgaaggtcgcgtgacaccagaaagtgtgatgtacagttatggaactctgttgcttgatcttctcagtggaaaacacattcctccaagccatgtaagccttatggtttaagatactaaatcatccactctgtaccaagtaccatatcatttctgagaagagtggttcttatctaatttgaactttacttgtactgtgtattcttaggcgctggacctcataagggacaggaacattcaaatgttgatagactcatgtttggagggtcaattttcaagtgatgacgggactgaactggtacggttagcttctagatgcttacagtatgagcctcgagaacggcctaacccaaaatctctagtcactgcaatgatccctcttcagaaggatcttgaggtattttcccacaaccacttttattttatctttcacaagttcttatatctattggctgatgtgttttgtgcattttaaaaaatcatgtaaagactccttcacatcaactaatgggcataccaagcagtgcctcaacaacgcctctttcaccactcggagaagcatgcctaagaactgacctaactgccatacatgagattgttgaaaaacttggttataaagatgatgagggagcagccacagaggttcacttccttaacaccaacctttttttttcttaatcattctcgtaattgtctcattgcaagtccttggcaagactgtaatccacagtgcattgagctacctagattcttattttaatctgatcaccatttttggctttgtttgttatctgcaaaaatgttcagctttcgttccagatgtggaccaaccagatgcaggactcgctgaacttcaagaaaaagggtgatgttgctttcaggcataaagactttgcaaatgctgctgaatgttattctcaggttagaacctttacttcttgattgtttgaggttttcaggcaaaccatatacagtttctgatccaaaaaagtgttgttattgacagtttatagagggtgggacaatggtttcaccaactgtttatgcaaggagaagtctgtgtcacctgatgaatgagatgcctcaagaggcgttgaatgatgcaatgcaagcccaagtgatatctcccgcttggcatatcgcatcttatcttcaagctgtagctctcacagctctaggacaagagaacgaagcacacgctgctcttaaagacggatcaatgctcgaaagcaaaagaaacgctctatgattatgataacaaaaaaaaaagaggaaaacaagagaaaaaacagctcgtaggctttgcagaatatgatcaaaacccaccaccatcttcctcataagtagataggagccactaaacggctctcatattgtgtgcatcctcatcactggtcagtttcgtagttccctcttttttttttcaaatactggatgatgcattcatttgcaaattggactctctttttttttttgtgtgttttctgttactggcatgaacatttccctattatacagaagaaaaagttgcctactttgattatggactgggaatggtgtgattgtggattttctttggtgggttccgtgctttgtaatcaatgttttgtaataacaaataacatgtatgtaaactttgtattttggctttttgatgatcttttgaattttgcatatcagagatgttcttgtttatgtgctaaacttttctgtcttgagatctaaatatctcatacataaaaaagggcccaatagggttcaaattcagtacgaatgctctaccactgagctatggacacgtggatgcatagtttgcattttttttttgttaatgataaatacattaatcttactcgagtagcatgtagaatagctgtgtgcaggagtccatgctcttgcttacaagaaaggatactagggaaagtaaaaaactaagtggtcttctgtagcttaaatctataaaaacacatcacacatgttcttttgttattttatctctaattgaaaatatatttggaagaatgtacagaaaggttatttttttatttaatttactggagtttcagaggctcctctggtcaggatattgtttctctccttttgcttttagttgggggtactgattgcatctgctttttttggtactactcttcaggatcactactctgaaaccatcaattggtatttgattgtgtcttttagcacaccctttctatgattggcttagaatgcaagtgaaaccaaagctttgtctttttaaaaatatttttttgagacaacttttgtccgttgctttcattaccttcacaactacttgattcctatgtaacttggacctttagatctgcaaggagcgtagctgaatcttgacttctctatcaagatttgcgattttaacgtcttctctctgtaaaagtttaatgaacagtgatagctcttccatcatttttgaaggagtgtctggtaagatcaactcacttttctttttatctgtttgccacattctcttctcttctcttatgtacaccattatgatcaaaggctcctagttttagtcatggaactggcattacaacaatactaatgcctttagaatcaaattctctgcagaagttttggccttgtctgatggttatatagatttgttgattcctacaaaagcagcaactatggcatcgcagtgttctgaaaacgttattcctactctacgtgatttcttcaactcccaaaagccaggggaagaggatgagtttatggttcatcaggtcctcaactcctcttccaagaacattccaccgagacctacaaaactaggaaacaaggcaaaagagagacacggtctcttcaatcagggaagaataagaagcagaagaaacatatcagatgctgaaaagttctctgtggagcaatactcttctagtggtttctttggggtacggttcaacacaaacggaagacaacaacagcaacaacgatcagctaagcctttagggtcagatagaaacatggaaccgagattgcagaagtcattctccgctagaatgcaactcccctttatgctatcttcaaagccaagcaaccagtctacgaataattcaagctggtttagccgtatcaagaaaatgtctaatccattttcaaatcgaaactctctgataccaaagtcaggagaaatcaaggtcagtggagtaggagaaacactctcaagaaacaagtcttcttcacctgttcatctacatgcccatctcagtatccaacatgaacttgggatgcctgttttcaccttctctctagaccacccggatgatgtgtatacggccaggacgtggatggatgttaacgactctcggttcgtctattcgtttcgttacattggtggtagaagcaacaagaacctcggagaacagaggtcgaacgtttcaggtatagactcttcacttataggacagatgcaagtttcaactcaagtctccttagaggtagaagaagaaccatacgaagatcctgttgaatcagccgtgtcagagttcgttctttttgacatcgcacgagcacggagaagtggactcaagactgaacaactgtcaagacagaacagtgtatctgatggcttaaagcatctgcaaaggcagaacagtttcagcagagggttgactcgtagtttctcaaaacattcagagaacagtgcatcatcatcatctgatccttggccagccacggatttacatccaggtctagagattgcagcagtcgttattaaagactcttattcttctagcaataatgagagttttgagtacatgaagaacagtaaactctctagacgagagatgaaggttatagttccatcaggaaaccacggtttgcctgatgctgaaaactcatgtcctacaccgatactgcagagatggagatcaggtggtggatgtgattgtagcggatgggacatgggttgtcacctttttgtcttagaagaacaacaactcatcaacaatcaccactgtctagaacttttcattgaggtatgatttattttcttgtagtagccaagctaaatgaatatctctgtggacagttccaggattagtcggctgggtctcggcccagcggacaccatgggttatccaaaaaaatattttattatggattatccaaaaaaaaaaaaaaaaaatcttgtggtggtgattcaacttgtctttcttgatcttgagatatacaaaaaatgtggttcagggagagaaggagaccagaccagcaatggcaatggcattcataagagaaggtcattacgaggtaaacttccatgcaaggctctcagctttacaagcattctcagtatgtgtggctgagctgcacagaacagaagtatcaagaggagaaagaagcgactctttgtctaggtgcagttcgcttagagagcttattgacatggcaactccggtaaacagagatatcaacgaagaagtcatttcgtctttcatgcctaatgtcactttctctccaatttcaagggtctaaaaaaaaacatatcagaacgtaatatctccgtaatatctccgtagtccttcctttatgtgcatatatagctacactcgacatataataaagttataaagccagagtctgtgatacaagtgcagatgaaattagtaaaatttagaactttagcagcacaaatgtttgtacttactttgtcctctatgactcgaagaagtcggtttgtttcaaattttatactctcacttgccacccgtttcataatatgtatcgttttcgaatctgttgtttttctatcctctatatcataaaaaaaaagtagtcgtttacctaaatttaaaaggaaattagtccatgtcagttcagcttatagagtaattgttgtacatacttgctttggaaacaaatctgtaataaaaatttagtacttctttatatgtgtgaaaactcttctaaaatgatcaattctaatttgaaatagaggaattgtgaatctcactttactccagtgtctttatcttatgctgctgagttttaattgactcggtctagttttctttttatttttcgttttaacatagttttattaaattttaatattataaagagtttacaagacacataaccaatttttaatttacttattatgtagcaattatgtgacttgtgaatataattggaaaaaacagtggttgaccatggtgtgaaaacattgtcggcaaacaaaaagacagattttaattatttttgtgtataaaattacaatgcaaaaggtaatcagatgcaaacgaatttaaaaaccaacgtttaaagatttgattatgtgtggaggaagtttctagcaacaattatgatttccgggtgcataattatgataattgcacacttgtgcatgggggtgggaccttggcaaaacttagcacaattatgataattgcacttgtcaatacataggaatctatcttattaaaacagaaacattctattggacctaacatttattctgtaagtttttaaattaaatacacttttatactttatagttaaacttacattaaatcattaatgtttctttctttatactgctatctatgtttccaaacaatatatttatttctttatattactatcaatgtttccaaacaatatatttttatactactatcaatgtttccaaacaatacaataattaatcttagttatgttatatctatcattttctttttaaaattgtgtagaaacgtcataatttcataaattgtaaaataatgaactttaaaatttggagtataagattacaaattatgaaattattacaatttaaatcaaattaaattacatatcggtcatccaacaattcaatcggttaatctcgggttttagtaatttttttaatatgaatattttaaaaacctaaattgaattgtcagatcttaaccggtataatcacaatcgggttgaatttaaaaacagtgatttaaatgtaaaaatattttaaatacacacttttaaaaattaccaaaatatttgttaagttattagtgaaatttttcatcgtaaaatattccgcgcttctaaagcgcgggtcaagatctagtttaaatattattagtaatgagagttctattaagaaaaaaaaagtaatcaaacctataccaaaaagagaataaatcaaaagagaggctgtccacgttgacaaaaaaatcggtcaatagaaatagagattcacgccacgtcagatgtgtcacttaagtcgttgggcttcgaattccacaggcccggcaatatgttcatgcatctgtaaagtattggtgctattttgttctcagctattataaattaaaaaaatatattaaatccctccagtagatatagactcagagtagtaagccatcgacatcttgttgaaacaaatgatctcaatttggttaccaaagttcaaactctgccataggttttaaaccttaggcagccaattccttagttatttactgggtttcatttgggtcgagctgactagtatattttggtgcttacctttaaacttttagtacgctatacataagtttcatatatataaattttcatttatgtgcaggtccatttattaggttgaatagttcttttgtaaggttttgtttacaaattcaccatgaaatttacaagtgttcaaacacatatggaatcttgaggaggcaactggtctattgggtgctgttattagactgccagcatggccatcctttaaatggttatcatctaaaatcttaacttctcttaactccttatcacattggaaacttgaaaagcaagagagtctatcaacaagccggccttccgtattgataggagtgtgatctccttggatctttctcaatcatatgtggctataggggctttcttaattggatgtcctccttttttttttttttttttttttttttttgatgtcctccttttctgtttaagaaagtcggtttgagtgtctttctttttttgtttatgattgtgtttgatccaatttggtggttccctatccttcttgttgtattggtttttatggtttgaagtaatgaaaggtttttccagtgtctaagacaagtcctgatgaaaaaactgtttgcaacagtataaacaaacaaatatctaaagtacaagataaatgtatcacaagttcaaaacgatggtaaagaaacagcatatatatacatcgatactcaaacaaaaaaaaagaagaaaattcaaaagaaaaagatatatcaaatagtagtctacatgaatgttcaccacacgagaactatgttgtaggttaacttaaacgatgaagaaatatatttatctttttgaaaattttctagataagagaagaagaaagcatgtcactctaccggtacaaatacaattttcatcggttcagaataatttgttgcaaacactattttctagttaattggctgggtttcttatttgggcttatttacttgataataataaagcccacaatataattgatcaggcatgttccgcgagtttaaaaacactggcttaaaatgcaaggaaggaataaaggatcatatataagatttaggttcattgacttcagtgacttgagtaactgagatccttttttaccccagttttggtgcgaagaaacttactgatcaagcatacataacttgagcccttgcacattttagtactagctagttcatatcacttgtctctgtatctgggatcttagtgggcatgtgctaagcccatctccaacacaacctcacaaattcaatctttgagagatgagtagaggtatgaatagaagtggctgatatcgagagagaatgcctgataaagagtagaagaaacaaggttaattaactcctttaaaacaaaattataaaatcacaatatattcttcttgatctaaaacacgcaaaagcatgcattgtatcagcattctccaatacatatgacgctttcgttgtgatccatagacatcaaatcgaaacgtgtgtttatctgtgtccacacaaaaccagctgtccgatttacctttgatttcaatcttgctcgtatctttgcttttcagatcataacagaaaaaattgtcattttgagttgcacttataacctttaatgtaataccattgatcaattgtagctgagaaggctacaataacagagtcttcctgactattccttgtttccaaaacccataaatccaccaaactcttgctctaagattggtttggtcaagaagagttacttctcctcaatattctataagagctcccattcgtgacatttgtaatcagctctctccatccttgtggtccatttttattatatggctttatatccccttttttcttaatatgatagctaatttaaagcacattttgaaacaatgcattttgtgtgagtctataaaagagtttcaatttaaaattctacacaatataatttcatgatttcctataactttttttttgtgcaactcaattgattaaaaacttagatgggttcatacaattggcccgataaacccattggagaaagcagattaggctagtctatctgcaggcccatgattttctataactattttaacataagatacgaaaattcgaatactggttattcattcataacattaattgtaaatccagccaagcatgccatagtttcagttgaatgaaattaattgtaaggttgctagctttaattatattagttcggaagatataaactatactataagtgtagtctattgttttgaatagagaaaatataaatttgttttaacagagtccttcttcccccaaataaatcattaaataccttcacatgggaaattaactcacactgcaaatattaatagcttgcttttggtgtgaagctacgtgatattgtagtcataacatttacttcgacatggccatctttttactagtattttataagtttcttcacaagattttgtaatcctgtgattaacattaatacacattcaattttcttcctgcttcgattaagaccctttacttgtacgttggtggtctacataaagacgtatacatatctgttttcattaaatacaatcaaagactattcgttttcttctgtcaacaaatattattcgtaattcttccttcttgataaatacttgtaccaaatgaaatttcggagaaaattaaagaacactgacaaagctagttacttaatttaggactcagttttgttttatagcaaatgtattacgtgttcgatttttgtatatataatattaatatttttttttggaaaataaattttgcatactatgaacacgtaacatacatacaaatatatcactgcattttaaccatatttgataaacacatttaaaaacctacgaaaagttcaacaaaattggatagtagttaaagcatttacaaaattaccaactgtgaaccaagctgaggtttgtttagtgtttgtgctatctgattttagcagtgtagatttaagaattcacgttaataaatatagcacattataatcagtaaaaatatttcaaaactgaaaacattaattaaaaaaaagagactaaaaataatttcaaaatcaaaaccaccgactaaagtttgtagtatgttggtttgatattagtattatcatcatgccattatccaagtataagaaaaacataattataaaatgtatgctttaatattaaacgatttgtcaacattgccatttaaacagaaaaagtagaattgtttttcttcaaccggtagttaagcagaaatagttgttggaagtaaaagactagtctacgtagctgtcatagttatttcacctatcgtaattaaactgagccttaatgaaaatcaatctctctctctccctgaacagtggtctatgtgtatgtgtgtgtgtttgtgtttataaaacggccttacgagaatcaacaagagtaaacttctcaataaaaccaaaatctctttcttaacccccaacgaaagaaccaatgagccagaggaacaagaacggccctaagctcgagctgaagcttaacctctcgccacctccttctcaagccaacctgatgagtgtagttcgttctccaagccgatccaacacaacttcgccaagctcatgcgtttcatctggaacgtaccaggaggagatggagacaacaatctcaatggtacttgttggttgccctcgttgccttatgtacgttatgctctctcaagatgacccaaaatgtccaaaatgcaaaagcaccgtcctactcgatttcctcaaccaagacgcctcccccgctacaactgctcctgccgccaccactgaacgcaataagacatggtggaaattttttgtttaatccaaccctttgtccgaaatataaacctataggctagttgatccaaccgtacttgtttctatatatttcttttgcttcttctcgtggttgtttggtgttagagtagtgctaatcacgctccacgtttagaccaaacattagcactaactttgcttttaatgcgatacgaaattatttgagcaaattatgttcagtatgatgaaacattcgcactgtgtgtctatgtgcttctaaacctttgcaccttggagatttgaaagactaatgtcctctgtttcttaaaaaaattacaaacggtgtttcttgaattaataaactgtaaaaagaaacattcgagattcggttggtttgttgaacataggagatacagagaaaacttattacaacatttatcccggttcgaatctcatttgaaactaaattctagcaatgtgaaaagtttgtgtttgaattcgacccaaacattttataaagtagtctggtaacatgaaattgcgtgtgacatgacattaatcagaatgtattttaaattcaaattaaaacaatatgataaacagtccattttataatattaaatatatttttttatgtgtgatcggaccaactgatagaatatattttttaaaaagatgctgaattttttaggagaaatttcatatatacactttttgagcaaatgatgttcagtatgatgaaacattcgcgctgtgtgtctatgtgcttctaaacctttgcaccttggagatttgaaagactaatgtcctctgtttcttaaaaaaattacaaacgttgtttcttgaattaataaactgtaaaagaaacattcgagattcggttggtttgttgaacatagaagatacagagaaaatttattacaaacatttatcccggttcgaatctcatttgaaactaaattctagcaatgtgaaaagtttgtgtttgaattcgacccagacattttataaagtagtccggtaacatgaaattatgtgtgaaatgacattaatcagaatgtatttcaaattcaaattaaaacaatatgataaacagtccattttataatattaaatatattttttacgtgtgatcggaccaactgatagaatgtattttttaaaagttcattaagatgctgaatttttaggagaatattaaattcatttaggtacctaaaaacatttttaaaaatacctaaatcattaataggcaaaaaataaaaataacctctcataatttcaatctaattatatgtttctttctattccgataaaaaactttgataaagacctagttgaaatggttagagatgaaataaaactaccataatgtcaaaaaaatctataaaatcatttgggtttgtgcacatagttttactcaccaaactcattacgttttacctaatattcatattgaaaagaacgaccaaagaacaacaatcatttgcatatattcttcttttttggaccaaaccatcatatatctaaacaacaaaagaaacgaaaattgtatttagcaaccctaatatgcgcatattcataggaaaaactaataggctttcagactttagtttgtagctactgataagtctaaatgctgaattattatatattaaatacaaaattaatgctaaggggttgaaagttggttaagattaaagagaggtagtagttatagcttcaatagattaaaattaattaattcattaaaatcaagtttaaatgcaatagtaactgaggcagttgaaaataatgatcgttacgtaagtatgataaatacgaatttaattcctcccctaataaaattagtataatttttattgtcaatttttttttatgttgtgtaattaactataggtcaccaattttcttctcttaccagacatttatcatcttaaattctcactaatcgcgtttatttacttaatgcaactgtcgtagcaattaaacgaagtagatctgtttgggccagaccaacttgcacagcctctcctaatcagcccattaattgttataaacgcttttaatggtcaggaatgtaaaatcacagaccggtttaaagggtttaaggaagaagagaccgtgaaattttacatttactggagatgcttaaatcggttcttgatcagagtggctacgtgctgcgcaacccacacggtgccagccacggtgcagcagaatccatgagtttgaccttccctctcgatagataaggaagtaccaggcgcctgctttgaaatctgcacagtggagattctaagtgagacgactagaaaaaaaaactgttgaatacgagaatgcgcttctgtcctttttgctttgaacacagttcccatgaaaagcagagttagaatcaatgagttgccttgtctttgcaatctgctgatgtttctgagacaagctaagagcagcatcaagctcaagaagcggttggttgcctccatttaaactgagaagtgactataagtagaaccggaagaaacacaagcatgatcgatgaccaatcagaagattcacgaatagcctaaccgatcaacgagcttctctaacagttcaatcagtctttgcttttcgtcgacgagtgttctgtcgtctaaataaagatacgtagcttattagattaattcatttttttcaatacctcgttaaatttaagagacgtaataagatgcgccaataaacatgctctaaagcaggtttcagacagtaatcataaaccagaggaagtttctaaagactagaactattggctgcgattgatgactgaggattagaaccttctccacccgatctgagataccaccgcctctgaagttttgttcatcgacgcaattgaaacaaccacagccttagtccatccgaggcgattgaatagtgatcaacaaaaaagctcctcgcgctgccatcatcggggccgggggtgatgaaaccgtagcctttccggtcaatctcgcattaagccctaatttcgactttgaccttagatccgccacgtcagctcccttctctaccaatcagactttactttttcgtatttaatattttttttatattcgctacgatttagacctgtttattttattatatatatatatatatatatttttttttttatattttaaaacagcaaaatttatatattaagatttttgactccacgtgtacactccaagtattgttgagctggacaaactgaaacaaggcagatttttcctcgtagtttcttgggatttgataattatgtaaagaatagtctgtcaaaaaaaaattgatagcttgcactatctatgagcattagaaaaaaacgtacctaagaaaatttgtgtatttttgaacaaaaaaaaatgttgtatttttttttcactaactaagaaaatttgtttattctttaaaaacgtacataagaatatttcatcacttccgttgtcaatcggacattgcatacaaagagaacttttgtctgtgtcgagtttgtttttggtgtgtacataattgttaaatcagatttagttttcttattttcttaacaatataatataacggcatcaaatgtaaatagaataaatttagatggttttatgtattttaggacctattcaagcaatatgcgggtttaattagagttagtctaataatatttcagtgaataaagaagaatctaaataattttctcacagtttatacgaataataaatcctaaaataatttttcaaacttgaatggattactctctacactaaaacatgggttccaacctgaatggaacttccaagaaagaggagagagactgtcagacggtggggaccgggtagcggacaaatagagtatctgatacttagattgttcaatggtgacaaaatgaagaattagagtatctgatacctctttctacttaaagtgtatctgatagttttttttgtttttgacttaaaagtgtatctgatagttttggatgtttttttgttctggaaatgtgtattttaaattttgaaattttcatctgccacaaaaaactgtacagtctctatgtttcaagctagtatattttcaacttataaatatattattttcaaactgatattgtttaatatcattgtattaataataattaaatatatttaattatttttattcaaagtttaaatttattatcataaaataataaaataaaacacaaaattttaatttaaaaataataataatttaaaatagaacattttaaaaaattgcagagagtgtaatttttacgggacttagagagatattgatatatatcacatgattaaaattagattaacattagatacatagaaaattctatttttaaaaagaagatgaagatcttatctggaatttttggtttaactacattaatagatttttaaattcaaacaaaacttggtactgttcttttatgattttaaaatttactttaaaacaatgtgttcctattctgtgatttatatccaattcaaatcatatatttttcaatcctatagaaataaatacataatatattttgtattgtatttagaagtaatctttattaaaataagaactaaatccgagagattttttttcgatatgtaaatattaattaaaattcacatattagatttgaatatcagaaaatgtcctttaagagcatcttaaaattgactctttattttagagtttgtgaaaccctatatttgaaatttcaagatatttttttccaaaagtaaaacttcaatttttttttaaacttcaaacttaacttcaaaattatttgtaatttgctttatagtctttttatttgtcataattaatgtaggtccataaaactttataaataactaacatataaaaacatattacaacaatattaattaataatatctaacacaacaatatcaaattagtaatataaatacataattaaatattaaaatacaagaaaatacgacattattacctaaaactatttatgtaatgctctatcttcggttactcaaaatttgtttggataataatttagagatttgagaggtttcagagcaaattttccagacattagtgttgtaatattgaaatatgggtaataatttttttcttcatgtaacttttaaaaaaagttatcaagtttcttttgtaataatatatattttttaatttttttaatttagttttactataaaacttgaatttataaaaaaaaatctgaaataattatgaaatatgaaaaattgcagattaaaaggataaacaaaaaaatacttaaaaatcataaatgtatgtgtaattaattgtaaaaatcaaaatgcaaataaaaattgaaacttctttgatgagtgaaacttcaatctcaaaactctaaatttgaagttttaaattttctttttatagagcaaaaagctctatattttaaagttatagaattgtttttacagatgctctatcaatcccactttcatctttccctcacagactaaacactctctaacaactttgccaactccactatactaaaataaaaaagcaacagcgtgtgtttagaattctccgtgcgtgtaatgatttcctttttatgtatgtcaaaaaagaagaagaaagatatgtactttttttttgctaaaaagatatgtacttgtttgacaaaaaaatgtacattacctcaaaaacaaatgcattaaaagatttatataaaattgaaacattacgcatgtattttagattttaatgcatttggttttgagataatgtacatttcactgaaatattagaaacgcattaaagaaatgtataatttatataaaacaaatgcattaaagaaaaatataaaactgaacgagaacctaatgcattacagaaatgtacattaccacaaaaccattaatggttaaatttgtttatcagcgaagttttttaagatcatgtcacttgaagactaatcaatcatatttgtttactcactagagagaccaatgttccattagtgaggttaagagagtatctaataattttttttttaaatacaaaattaagagattgaagacggagatattttacaactgttccaatttttaatactcaaaatcatatttacttttcatctattggtccatctattttaaaataaatcgaaattaataacaacaataaaatatcattatttttatattttaggaactaaaaggatttctcatcagaaaaggtttctcatctaaataatttttcataatacacacgtttcagaattaaaaacctctattataatctagagaatttgaatggtttgaagaaagaaaagagaaattaccggactgttttgaactcaatgattgacccgacgctgaggaaataaagaacatataaaacaaaagaaaacaaaaagagttagtgaagtaaaatataaatgaaagattattggaggtataagaacacatggtacataaatctataaaaaaatcttctttgtgaatgatatttcattaaaatcagaaccacgcaataagagcgcttccatcgatttaaccgatttaatattgatagttttaatatgatttaattattgattaaattttaaatcaaaaacaaaaatcaaaccaatcatataaagacaaacacaaagacaattccaactttttttgtttgttggagtttaaagcacaatctcttttttttttctttttgtccacttttctatttcttgttactttttaattaatatataaatagtgctctgaaactcttctagatgtccttaacaataacgaaccgttcaaaattttaaaattgtaaataccagttagaccctatttatttattttggttcaacttaaaccattatcaatcttgcgaaaaatatttgtatcacatcaacttgttttagttagtgttattaagtccttatttgatccctctttctataattataaaaaaattattctcctctaagcctaataaattccgatctgaaataaattataccaaaatcgaattttttaataaaatataagaatggatcaaaaatttaattgtcaaataatagttcaaactcaatctaaaccaaaatattttggatatccaaaatacttgaatcacaattatatatatatttgaatatactaatatttgtagatttaatatccaaatacactaaaatatttggaattatccaaaacacctgaaaaataaaaaatttatccaaaaaggtaaaaataaatatcttaaaacaactaaaacactcaaaacattaaaaatataagtaatatataccgtttctccacccaaatatccaagccgaacaaattttcatgtcaattttagatatttggttatacaatattcatatttatatattatatatggcattatttttggttttgagattttaaaatagatttggattattgttgtttttacataatttaaatatgtatctgaacccaaaccaaatctctaaataatttaagttatttacgtattttagactcttgaaaagaaaacttgtaattacttaacatttagatttataacttcaattaattatctacagaaaatttgcattcaaaattagcaagagtgtgtgatctagtttgcattataattaaaatagtatttttctacccgtacatagcaaaacaaaatttaaataaaacatttcaaactaattcaatctagctacttttggcaagctaagctctgttctttctcttcctgttctctgcaaacaaatatcacgagagttgaagctgctctctctctctctctctctctcccctctctctttccggatttcttcccctcttcttctctctttcgctttggatattttgatctccaatggctgccaaagcgtttgcttaacgaacaggtttccctcccttctctctttcacgtgtcttgttctggtgttctctctctctctctctctctctctgtgtgatggagatcgaggagctcgagcttacacctctgagacagccttctccggaaatgaagcagagttgggttctcaaaccaacactctccaagaaaaagaagaaactttctgttgcttgcatctcaagcaacaaaaggttacttgtatggcttggaggagtcttggctgtgtcgtctatcgtcgtgataacactgttcaagacactcccccaccaccagagcattccaccaccgcaagacaatagcaccatcgcacttcctatggcattgaaatttttcaatgcccaaatctgtaagtagagatgttttgaatcaaagtatatgaccaaatgaatgtaaacgttactcttttgatgttctagccggaaaactgccagaggggaataacgtgtcttggaggggaaattcttgcttgaacgatgggaattttcccgggagtctttacccacatctggcgggagggtactacgatgctggaggttcgatcaagacaagcttcaccatgtctttctcaatgacaatgttgagctggagtgtcattgaatatgggtcgaaatatgaggcttgtggagaagtggaccacgtcaaagggctcattaaatggggaaccgactacttcctccgcacttttagcagcagttctgatacgatctatgaaatggtgtatcaggtataaaagttttgtttcccttccttcttgcatactcaattcggttcaggtcctaaacttttgtttttcttttcacagatagggatgaatcaaggaagccaagtgactagtgacctatactgctggatgcgaccagaagacattgattaccaaaggtctgtcaatctatgttacacagactgcccgcatctcgctgcagagatggcagcttccctggcctcagcctcgatcgtattccgtgaccaagtcgactactctgcaacacttgttaacagtgccaaagccgtttacctttacgccgaggctatgagcgccaagcggaaaagcgcagatcactgggatgacctcatatgggggggagcgtggctctactatgccacgggtgataactcgtatcttgctaaggtaaccagtcacgatctagccaaccgtgccggtgccttttcccatggccctcgttatggtgtctttggttgggacaacaagcttgctgggacacaggtttgttagttcacgaggcttccttagttctgtttttcttccaactgattgcttgcttgcttgcttactctctgtttttttttctgtgtgccttttttagttgcttttcactcggttgaggctgttcttgagccctcccttcccgtatgaagagatgctcagggtctttcatgagcaaaccagcatagtaatgtgctcctacttgccgtattacactaagtttaacagaacaaaaggtatcagatttttgcctttgttattctttattactaagttttgattgtgtgtatacttgtgaaagtgaaactattggggagtgagtttttggtcttatgtgaagggttatttagttaggatgttttgtgaaggattatgcgacttgatttagtcaggatgttttgatcttttttagtattgagagtgtatatcgtctgctttcatatctgcaggtggtttgatcctgctgagcgaaccagagcctctccagtatgctgcgaatgcagctttcctggccactctgtacagtgactaccaaggcgcttctgacgctcctggatggtactgtgggccaactttcttcaaaactgagatcctacgtgacttttcgacatctcaagtattgaaaccattaccattatatgatcatctccacagttcgatcttatctgatttaagcgtttgtgtgtttcttcttcacgcaggttgattacatactagggaaaaacccacacaacatgagttatgtggtggggtttgggcagaaatatcctaaacatgtgcaccataggggagcctcgatcccgaagaacaagaaagtgacatgcgaaggaggtttgaagtggaaggagagcacgagcgagaatccaaacacgatcgaaggggcaatggtcgctggaccagacaagaaggatggcttccacgacgtacgtgtaaactacaactacacacaggcgactctggtgggaaatgcaggtcttgtggcagctcttgtagcctcttcacgaggaggtggaggatttgatagaaacaccatcttctcagccataaatcctctgtcgtttgcaccgccgcctccagtacctgagacctgagaagatttactctgtttttatgcttttattattggacttgtttcaagatatttgttgtgattttagctcaggtttgtatctcttctcttctttactcttgaactctctttttctctgttttgttgtgcaagacttgattttaccaaacaactttttcattcattcttgcatacattcttacaaacaaacaacacacactctttatagtagacttcttgctgacttacaactaacacagcacatgacacatacctctagtctttaactattacaacaactctcttctcaactctctaatcatatctgaacttagttggcttactaaccaactaactcttaacttgctacttaattttaacagctagttacataactaacttccttgttgaccttgatctttgacttctcttcttccttgcttcatccacagtatttgcttattcttcagaacatctcaaagtcatcgccatcttcttcttcctcttcttcttgcttttctatcatcttctcattatgatttttgtcttccttttcttttgcaggtttactcaaggaatcacttctcaacaatattgtttccactcaaatctgttccttcactgaaggagacaaatttataatctcttctcaatattgtaacacacaagtggtaggaaagacttgaaagttgatctccttgtaatccctgacgtctctcagagcatcatatctcacactcagctactattttttcttcaaccttgcggagagtttcaagttcagaaacctgactatgtgtcacattccaaagctatcttagtgatttcatgactataatgctgatcaggattctcctcagagaagatctcccacaatgttttcctgatgttttgattcgatattgcttccttgagctctatttagtttatcactcgcaatgtagatgccgcttcaaaagcttccagagcagagtagccttgcagagcaacatggccttacctgcagcctctctcacagccatttgagtctcatcaagagtctggttcattccaccaaataacaacttaccacaacttgacaactgacatagcaacctgttaccgtttaccaatcaaatgacattatataatacttcctattcaagtatgaatcccctttttcttagagctgatgtctctctcggtgaccattaagaaaccagtttggtatatgaaaatcaatgataatgtcacacttaacaagagagaaaatcaatgacaatatcacacagagactttaaaatatagccaaggcatcaatcaagatcaagcaagttcggatcttcaggcaaaaccctaaattcaactacaaacaaccgagatccatggcggctttgatctgtagctatgaaaaaatcgataggagagaggagaatgaaagagttagttattcttggctttgagttttgggagggaaataaagtagccgttacggtatcaacggatcgtttttggaattttcaaggggcttatctcatgtgtgcgggtgcacattagtattaacataattgttaatataacattttaaaacaataattttatttattattttgaataatcatattttgtgattttaatcatctattatatcacagtgtaacatataaaaatccaatatttataactaattgaacttatattacgaaagcgttatactaatgatttatgaatattttttgtactaatgataatatatatatttgtaaattaatatgtattacataatttttaatataacatttaaaaaacaattttatttattaatttgaataattatattttgtgattttagtcatctattatatcatagtgtaacatataaaaattcaatatttataactaattggacttatattatgaaagcgttataataataatttatgaataaatgttttatattttatttatatgttatataaattgattttgatgtgtggtttttattttatttttttattattaataaatattgaaattaatatgttaataaaaatctattaggaaatttattttggttaatattcgattaagaaaatctattatttaaattagggaagacattaaatacttaaatctattatttaaataaggaaaagacaaaacctccttaaatataacttcatttaatatttgagttgcatgacattataaataaaataaaaaaattcaaggctaattcaattttatacttttattttaatagtatagatgtttgcatttttcaaagcctctaaacgagactttttgatggctttggaatttttttttattttttttttaacttttttctcaacaagttaaacacttaaaaataacaaaatatttaacaaaattaaaaataaatccaataaaaatcaaaataaatctagataatatgctatactttttttaaattaaatatttgtttataagataatgtattaattaatttcgtgattagaaatataatgttattttaatacataaataaatataataattatataaaaataaaattatatgctatattttttaaaagctttataattacagtgtatagtatattaaattagaaatcctctatgaaataaatgtaaaattttaaatcatgtaatgtttttatacaaacaaaattgctgaaatatatttggtcccaagttgaaccagttaaaaatatgccacaaatcgataaagataaaatatatattaaaatatatacaaaaacggtttgtaaattaataattctataaattaataaaatatcatagttacaacactattaatttatagggtttttactatatttataacagttacaatttctaaatcttttgatgccagtcaagctttaaatttttttaaaagtaacagctacaacttttaaagttaaaatccctactgctaaaattctaaagtcatagtctaaagcgaaaattgttagcaatcagagcttcaatattttttttttctagccgtcggataatttttgaattcaaaataatatcagatattctagtctccttttcctcgcagtcctacaatctttcttcgaacccatgtttcaattagggagtactccattcaaattctctaaattattttagtttttttctatcagagttttcttaaattttgaatctagtgtaaattatgagaaaattattcagactgatcttaattcactggaatattactagactaacctcattaaactcacgtattgcttgaataggtcaaacatacataaaaatcttctaaaattattttatatacctttggcactatctatattattatttatgtagtgatttgacttatttgtcatcttcttgattttatattttttaattatttttcattgattgttgtttatttgtcatattttccaaaattttaggtaattttctgatttcttatgtttttaataattttagttttaattatttatcatattttccacatttaggttatttatttgtcatgttcttaataattttatcggtaatttttatatatttattatattattatataatttaggtggtaatttgggtttattttataatcaattgttaatcttaataagtaatttagggatttagctgataatttttattattttgagaataattaaaaaactaatgatagtatcatatttaaatttatattatatttaatatattaattttaaaatattatatatataagataaaaaataattatcagctaaatcactaaaattacttattaagatttattattgattataaatttaaaaaaactaaaattacggagagaatgaaatttaatattactaaagtaaatataagataaatttaactatgatattatcattagattttttaaaatattctcgagaaaacaataaattatcagctaaatcagtaaaattatttattaagatcgataaataattataaaatatgactaaatctaaaattatgtagagcatgcaatttaataatcaatcaaatattaaagtttacatgcaactattttaataaaatatatatttattacgtaaaataatcttgaaaacattcccatatatataaaactatatacattgatttgtatttattttaaaaatagtacgctgtaaaaatatttttggataacataatatagaatcgttttagataatattgattataaaattaacgaaattcgttttaaatttatggataactatattatatgatatatattaaaatataattagtttaatattactaaacgtgaatatatgaatagggcgaaccactccgtggatatttttatttcaaaacaatataattagaattagactcggtcaactggaatgtgtattatccatataggggatttttcaattgagaagatctatcgacctgagacgaagaaaaatgtctatctattttatttagttattcagttgattcgttattaaaatggataacgacaacaatttcatacgacatgcgtatttttgattttccaatggatttatattcttcattaatggaaattcttttgatgtagtgagtaatagttatggttgttcgctgtttaagaattcttgtttagacagttcgtaccatccatacataatgttttgatctaatattccaactcttccatgtttccatcgtagtatattgttccatggaactaagtggaagaaacatgtgtttctacaattctaccacccagtcaatttcggctaattaatgagaaacctttctcttgttacattacatgaatcataaacaaaatataatatacacatacatatatgtactaaagtaaatataagataaatttaactatgatattaaaattagtttctttaaatttttctcaagatagcaataaattatcacctaaatcagtaaaattatttattaagattaataattaatcataaaatatgactaaacctaaaattatggagagtattaagtttaataattaattaaacattaaaatttagggtaattctctcaaataaccattttaagtttttgtcacgaaaatagcactcaaaaagtaaaaagaccaaaatagcctcttcttattttaaaaatttttatttttattttttaaaatttgaaaccctattccaaaacccacctcttaactctaaactctaaactctaaatgtagattagctaacccttagggtataaatgtatattttaccctttaataaaaatttatttggtcattttcttccttgatagctatttttatgaaaataaactaaaaaggattatctaatagaatttctctaaaatttatatacaaaatttttttatcaaaatttattttatcatgtaaagtaaacttgaaaacagtacatattcataacactatatacattgatttatatttagttttaaaatactatgttgtaaaatatttttggataacataatatagaatctttttagataatgatgattataaaattaatgaaattcgtttaaaatttatggataattatatatttatatatatacacacattaaattagattcagtttaatattaccaaaaccaaatataatataaacacacacacacacacacacacacacacacacacacacacacacacacacacacacacacacacacacacacacacacacacacacacacacacacacacacacacacacacagatatatcacaaaatatataattgctcataaattttataatcatcattatttaaaaagattttaaaattattttatccaaaaagatattacatcgtaatattttaaaaattaaaataaatccatgtatataattttatgtatatatgaaagttttcaagtttattttccgtaataaaagatattttgttgaaattaaaagttattgtatataaaaataatatttaaataattattaaatattttcaaaatataaaaataatttattttaatagtcttctgaatttataatatatctatttacaaaatttggtaagattatcaagcccgtaagtgcgggcaaaacacctagttatattatataattgaaaacaaggatatatcatataattgaaaacaaggagaaaaaaatagttatttattagggggttttattcgttgatgtattgtaatagagtttaaatctaaccataatctactgttatttgaatgatgatttaacattctattttaaatatagtgttattcaatgaatgatttaaattcagtttttaaaatctagtgttattcaatttttaaggattgtaattttttttgtattttcaattgatttcaaatcatgagtctaatgaataaatgagtgaactcaaaatcaaaggtacactaaagagattttagaattcttgaactttaaattttaaaatatgatggattgaaaatcactgatcgaataacactacctaagtttaataatagaatgactctaaatttattttaattactagtttagatttcatgcatgttatacccttaagttcattgttataaaaaatagtaaataaaaatttgtcattactcaaaaacttattttattcatattttatgtagccacatacttatctttatttttctttggcgatagacttaccttaaaatcgatagacaattagattttcataaatatgttatgtttggtaaaatatttattaaatattcatagatttaattagatttagtttctttgaccacatatttactaattttgatagatttttttttgttttgaccacctatttacttatttttgacagatttatttggatttcaactgatttattatcatttgaccataaatttaattaattttgacatatttaatatggatttgatagatttatttattctttgaccacatgtgtaattacaatttgatagatttttgtatactttggtgacagattttatagttattcagtcacatattaattaaattcaccttaaccaaactggttattgaaaactggatctaaccattaaattctaaaattttatataatttaaattgaactaaaccaaaatatttctaaccaataaattaagttaaccaaatcataacaaaaacttaatttaaaccaaagaagaaaaaaaccctaatctacaaaagaacatcacgtgtcattctttagcgagagattacgtctcctatgtctttcattgttttcgtttttcactcatggctctggtaaaattgtttgtggtatctctggaatgcttcataatcaagaactctctttgcacactctaacgggaggcaaatccttatttccctatatttatttcatatgtcaatctctacagggcacatttttttaattttatatatcaaacaaaaaatcataaattaaaatggaaacgtgaatattttttatttgatttatagaatttgataaaaatatttcaaaaatcaaaaaattgttttttcataatttcgcgaaaatcatcaaaatatgatttaaaacgattttaaaatatattttttccaaatttgaaaggtatagaacttaaatatttgcccatggtttcactaatccatagggggtgttagggttttgttttgaagagagaagatgatttgatttgggagtttaagttttggtcaaaaaaaagaattatgaaaaaaagatataggagatcaagtgaatccattgaaaaattgtctctagagaaataggggaatgggaatgggaaaagttgactcctctaccagaatatgacgtgaggaagctattccatagacagcaagatgaagaacacataacaatctaaccattgtcctcttctcgacactccaatatttgcatctttccaatactaactgaagctgaaccatgttaggaccaacaacggtaggaacttctttctttccaaaactctgcgtgatcaacattacaaatgtcctcttctgaagctgaaccatgtcctgtgatcgctatcacgaaattctgaaaaagagagacgaatgagctgcacatcaattagaggtgtcaactgggcgggctgggctgtccatggattagaccggtccaatttagtttaggtaggctatgaacgctaattggtctaattgtacaaaagaccaattggtctatggtctaactgggcaacgaccaaatggacaatgggtgtccataggcctcctagaaatatagttttccaatttattgaaaaacacaattttaacgaaaaatcaaaactttgcgatttaatagaaaaacataagtttacgattttagcggaaaatgtaattttacgttttggcgggaaaacgtaattttatagttttggcgggaaaacgtaattttacggttttagcggaaaaacgtacttttatggttttggtggaaaaacgtaaatatacgattttggcgggaaaaaggtaattttaccattttggcatgaaaaacataatattcggttttggcatagaacgtaatttaatttttcagttttggcgagaaaacatgatttttttattttggcggagaaacttgatattttaatttttggcgaaaacaaaataactaaattttggcggaaaaacgtgatttctcaattttggcggaaaacatgatttatcggttttggccgaaagcacgattttccggttttggcgggaaatcacgatttccggttttggcgggaaatcacgattttccggttttagcggaaaaacgtgatttctcggttttcgcggaaaaaaaattctcggttttagcggaaaacatgatttctctgttttggtgaaaccgcgatttctcggtttagacttaccttttgtttgaccaaagctttgtgactctatgaagcatttgtgtttcttaattgaattgtgagtcttgtgacccctggtttgcatctcttcctttggttatattgataaacagtgctattcctccttttccaatttttgattttaatcctgattcgttttttattaaaccatattttatcttccgatcattcaccattcactgccactaacattctcgataattcaagcttcgtttatgaagataaattatttgaaactttctatctaattattttgcgtttatgatctattgataatatgaatctcatctaatgttatttaagagttatgtcttttcataaactgatattagttttattttttcaacatacaactattaaattttataaagtagatataatatcttaataagagactcttttatttttaagaattgttcttttccattataagagttgtatctttcataaaatgagttaacaataataatttaaaacatgcacataaacttcaatgtgtgtgtctttaccaacatgttaaaacttttaagttatgcggtatttttttcatgtaacaatcaaatagtttatgagaatttatttttattattctcaattttatctctgtttaatgcaattttattttattttacatgaaaacatgtatttgtttattcaaagattttttctcttgtgaagaaatacatcctttaagaatactaaaaatgttgcaaaatcgtatccttccaaatttgtaacacatgtattttcttaaaaacaattatattttttttaaatgttattttataaaatatagcatatttatatttataaatgagttcccgtgtgatatcgcacgggttccttacctagttaataataataataagattgcattaatacatagtaactgatggaaaccagtcgtagcttatgtctttgtggccaaggctatgtgttaattaatattattactagattttgatccgcgcttttgaagcgcgggatattttacgatgaaaaatttcactaataatttaacaaatattttggtaatttttaaagagtgtatttaaaatatttttgcatttaaatcagtatttttaaattcaacccgattgtgattataccggttaatccggagatctgacaattcaatttatgtttttaaaatattcatattaaaaaatcactaaaacccgagactaaccgattgaactgatggatgatcaatatgtaatctaattggatttaaattgtaatagtttcataatttgtaatcttataatcgaaattttaaagttcactattttgcaatttatgaaattatgacgtttctacaaaattttaaagagaaaatgatagatataaaataattaagattaattattttattatttggaaacattgatagtagtataaaaatatattgtttggaaacattgataatagtataaagaaataagtatattgtttggaaacgttgatagtagtataaagaaataagtatattgtttggaaacatggatagtagtataaaaaagaaatattagtgatttaatgtatgtttaactataaagtataaaagtatatttaatttaaaaacttacaaaataaatgttaggtccaacagaatgtttctgttttaataagatagattactctataataaccaatggaaattaaatgggtactaaatcatataaaatataaaagtgctgtatcaattttcccttattgcctcattacttgatattttgttcgtgaatattatcgtttatagaaactatttcatttaaactatgtagagtagttattgtaggaggctaaaatctagcaattttttcaaaaaaaaaaaaaaaattctagcaattgccaaatcttttgttctatttgatttacatatcttttgttcagatgaataatatattttgcaaaccctatatatataatcttattcattaatcggtttcacaaacactccccctttctaaagataaaatagtttttgagttgctaaaacaaatagttatttattataattctaataggcaattctcaaaaaaaaatatagttcttgttatacttaatttttttttaatgtcaatagaagaataaaatacaaattttaacgatatatttaattccgcatctatctaatcttatttatttcgtatatgttagtatactagatgatgttgaagttggtatttcatatatgaaagattatatatataattatgactttttcttgggttcaccccctaggatgaacctttaggttcaccaaccaatagaaaattgttattttaaatctaatatcttttaattaagaaaacaaaaataacctgccaaattatattatgcttttaaaataaataaaaagattaaataaataaaaataacaatagttctcaataaagattattttaaaaaatatttatttataagatttggagtttagtgtttaagatttatagtttagaatttatccaaatgtttagtgtttttccaagggttagggtttacccaaaggtttagggtttacccaagggtttagggtttaggattagagtttagggtttagtattttgttgagaacatgtttagtgttttttccaaaggtttatggtttatccaagggtttaaggtttatgattagagtttagggtttagtattagagtttagggtttagtgttttgttgacaacattaattttttttaattcgtttttatatactatttttatttatttttaaattttattttgaaaaaataatataatttgacaaattatttgttttcttaaataaaagatactaaatctaaaataacaagtttctattggttggtgcatagggggtgaacccaaaaataactcattaaatcaatttatagcaaatactaacctagtctaacagatttccagtcaaattgtttttaaggaaacccttacataatacgaaagattatacatatacaaaagattataccatccatatatagtaaattttaaattcgttgaacaaatttatagtcaaagttttgttatggaaaccattacattacgagaaatattttatatataaaaagttaaaaacaaaatattatatcatccatttatagtaaataataaaaactgttgaccaatatgcgttagaatatagaaaattaattatgaatacttataacaaaatatgtgttaccaaaaatggaagatctatcatgaatatatataaacacaactagaccaaacgatcaaatcacaataagaagaaaatacaaaaaggtaaatcaagtaagaaagtcttttttttttcaagttagaaattcatatgcatgtcaaggttagaagttttcttttgaagaagactaaatttatttctttgaaaataagtatttaagcatctccaaatactttttagtatacaaagttttaatttttttctaaatttatttattcatattgtaaaagcgtatatgttttagtatatgtaaaagtacgtaatcagaatttgtttcttaagagttattacactagaatctcgtctgatgttaattttgaaatctgtatttttttatttctgtgaaggatacttggacaaagagtttctgtaacctacacatacatatcatggcaaccaagaaaagtttatctattatgttgtctctgttaatggtcttgactctcataagcctttttcctacaatttcaggtaatattttttttaactttaggaagtatttattttatgattttattaacttaaggcaaatagaaaatattctaccaattcgaaattctctgaaaagaaatcaagaagtttttagatgattcgaaaattcaaaaagactaaggagttgagttaaaatatgttaatttgctaatttttaatttgaaagtaaaactaatgctaattatattgacttaaataggtaacgaaggagaatgtcaacaacaggggctatgtgagggcgcaaacccggaaaagacctgcaaagcaagatgtatttctctgaattacaatctcgggggaatttgcttaaaacatgcaaatggcccagacaaaccaattacttatttttgttgttgcaagatataaattaataatgtctgagactataatattttatcaatttataaaattattagtttacaaaagttccctttttatttttattctaaattatatctttatataaaataagaaagtaattaattgaactgtatatacattaattaagccttagaaatttgaatttcatattatgttttatattgtttggtgtatatgttgtatatgtttttagatctaaatgtggttttagatatagttttactaaatactattaaaatatattgaattattaagaaaaatatttataatgccatgatgaatattaaatagcattagaatgtttggtttggacatatccttgtatcaccactttcttatattatgtgtcctatatttactaaaactatgtcataccatataaaattagaatgtttggtttggacatatccttgtatcaccactttcttacatttcacaaactatgtcataccatataaaattattttgagacatttgacttaggcccctcttacattagttaattatggatgataggttttaaaattcattcagaaattagagttaagatttatgataatgtatagaataagtaatatatgaaaagaatgtttactaataaaggtaacatatactcggcctccccactccatgcggaagcagaaggtgttatttgggcaatgcaggagctgttaaaaccgagggaaaagagagattcagctgcgatcagactgtgagcaacttgtgaaacttataaatactgatatggaatggccagcattggcctctgagttggatgaaattgcagcactgtctaaagagtttatgagcctctctatatgcgcaatcccgagaactcagaatgcccgagcggacggcttggcaaaagggggacgtacacgcaagctcatcccgttcgttagtgactccgcacctacatggctagcccctgaagctagtctaacggctgtagagtaatcttttatttttattcgatgtcaaaaaaaaaaaaagatcttggtataaaatatatacatattatgattttatggactgatacaattgtagtgacccaagtgcagatataagagtaaatgagtacaaccttctacttgtaaaatattaagagatagtttgtgaaatgtaaagcttaggaccgccttctatttctctttggctgtcctttatgggtactgacggtggattataatggcgatatggtctctggcgagtattaagtatctttaagatcacatttactgtccgatcttctttatgttttgatttgaccatgtctgttcggcacagactatcccctcatcttgcgatagacctattttcttcttcttatcgggcctttgtaataattgacccggttcttggaccggtatggattaaggtgaaacctacctccaataataatcatccagtcctcggtcatcagccaggtcaggtgtttattccgatttggatggtatgtttgacgccgaaggtttatgaaaaacccagtaagagattctggtttattgaattagttgtgagatttgattgatgtaaatcatgggatttgattttcccttcttagaaagtcaatcttcttagcttggcaattatttccttttgtggtttctgtctcagaatataacattcttgtcttcttccttggtttttcattcttttaatcaaaagaaaaggaatggtctttttctctttctatatattttgtttctattttgaataatgttcattttcttttgtcattattgtagtatgattgttcttcgccttctatttctcaagtgttttagctactattttgagttattctctttgactgtttatatcgaagtttatgtttctgtcgaggttcataatcttgagattttgttcggttgtttgattttgttttttatcgtttgtttttcttttagtttatatagtgatgtttttgccttcggcatcgtcttttggtgagatttctctcctttgcgtctctgatatccttatacatttttggtttgtttgttctgttgatcttcttatttcatcatatggtggccaaatgtcattatcctctccaaccaatttttaatttacttattatgtagcaattatgtgacttgtgaatataattggaaaaaacagtggttgaccatggtgtgaaaacattgtcggcaaacaaaaaggcagattttaattatttttgtgtataaaattacaatgcaaaaggtaatcagatgcaaacgaatttaaaaaccaacgtttaaagatttgattatgtgtggaggaagtttctagcaacaattatgatttccaggcgcataattatgataattgcacacttgtgcatgggagtgggaccttggcaaaacttagcacaattatgataattgcacttgtcaatacataggaatttaaatatcattagtaatgagagttctactaagaaaaaaaagtaatcaaacctatactaaaacgagaataaaatcaaaagagaggtccacgttgacaaaaaaaatcggccaataggagtagagcttcacgccacgtcagatgtgtcatttaagtcgttgggcttcgaattccacaggcccgacatcgttcaaattcgagaagcccgtgaagcccatttcacatctaagctccctttccccttcctcttcgcgtcttgctcctttcctattaatcgatgtgaaacagagtgaaaagatctaagaaacgtttgatgtagccctggaaggaggcaaaaatttcatgctgatttttgccgtgttcgtcttctcactgttaactttccagtaaatattctctattcaatccttgcttcttttgtttgacaactacgcttccagagaccgtagacaggaagaggaggagcctctgtcttcctcaatccgaactgcagttccccattcgttttctccctttcggattccctcttcattgcctcccgatctcataaccatctttcctaaagctcattcattactgcatgaatcaaaagccaagcaacagtttcaacttccggtgctctcgattcttccattcatcgcacttacatagactaaatgatccctgcaaccatggcaaataaaacgtcctcatcaaccagaaaggcaagacggcgtgcgttattataaaacaatgttggccctcgatttcggctaatttcatttctgggaattacgtgagtatcagtcttagtgtctcttttcctttcagtgtatcatatattttatgaactaataacaagaatcatttgcaggcggagtaagacatagattctgcaatgctctcctctctgccagagaagaaattgcacagattgaagaagttaatgcagatgtgcagaaacaacatccttaaggtaatctaaaaagggaacattcagtatatctctcttagtttcttcatcaaattgaacacgagacattggaggattgtttgttagcgtatgttttcagagagctccaaatcctccatctacgacccttatcagttacttgatcaaacttgagatcacaaatacacgcatcaactttaccgacaacgctttcaagttccaaaggttagtcatcaacaacatatccgtttgaacgttactattttcttattttaacacacggctgctctgaaagccatcccagatatatcggcgagaaaagaaaagaagtttgcagcaactgcctctatgaaaactgatttagagaagaagaaaattgagcaatgtaagctagaaaagtggaggtacttttctcaggattgtattatttgaagcttggattttgaaacggagattatgcttcttgacttttgcaggaatcacatacgagcaaggaaatcttttccacaagagcaggccgccagagaaaaagttgctgatcgagctatttattttttaaattgcacaaccttttgttttttcaaatattttgattacagtcttttcattatttatgcttaactgcttgaggaactaagctgccaagcaaggtacaaggttatttgaatataaaagtccaacagtgtaaggaagttgaaagttgtttcttttttgttcttttgtgctatctttaaatcgatgacaaaacaactgatttatcctgtttactataggctggtgcatgtggaacggtacaatagactatggagaattcatgatagaagcaatagtgcacataaacagattcacggagttcaattgctaacacagacacaatgaaaaaaaaacgtacaagtaagactcctttcctttattgttttttttatcgtttatgagtcgcttcgccagttttgctctataacttttttttacattcattcctctttaatctgtagctttgttctaaacttctaagtcgtggtctctcttaacatcttgaactcttaattttgtcttgagtcaaagagagagattgattgctcccatgtctcatctgttgagaagaaaaactgtcatggctcccgagaaatcctctcagccgccggacatggagacaaagttggatctagagccagagagtcaaaggtaggaggttatcttgatccagcaaaattaatcaaaaagttcgtggaactttttttttttattaaaaagatcgtggaactttgcatacaaactttgaaagcaagatctcagtctcagccagcacaacaatgaagtaggaattttaccacaaaaaaaaacaatgaagtaggaaaccagcattcctcctgcgagctcccatcctccaaaggctaatgaccaaactgttgactctggccaaaacaacaagttccccgttataagcgaaaaacttatcaacaacgtcatcgattacaggatgcttttattgtgatttttattgttttgtcctttagtttagggttaaattatctgctatgtttctagaaacaatattttaaatcccattctggatatcgtttcggcataagtttatatcatgttcattaagattctttgacgtcaaagtttaagcaaaaaaaagattctttgacgtctgctacaaattgtataagctcaatctactatgtataacacccattatctggaatgtggagatctttagacttcctttttgttgacattggagtatagcagatcatatatgtatctttttaagggcattcccattatgttgggatcggaagccataactgtgttatgttcactgacactaaaaaatgatactccctctgtttcgaattatttgtcgttttagagtagaattttcgttttaaaataagtgtcgttttcggttttcaatgcaaaatttattgacaatattctctgttctatttttctattggttgatatatggttaggtgtattgaaaatggtgtttttattttgaaaatatgtaaaactaaatgttttcttaatctgtgtacataaacctagaacgacaagtaatatgaaacgaagggagtatactgtcaccaatgccgttcaaatgtcaaaacaatctaattatgttttttttcttctcattatcggtttagttattgtcatagatttttaatctaataactatataagtcctccatttaaaaatttaacacattcattaaattttaggtcattaattagtatagtcatttaatgatgcatattatcatacaaaatgttttaattttggaaagtcaaaataaattattaaccaagcagaaaaaatagttactaatacaagaaaaggaaaatgatatattattttaaataaatattctcagaatttttataaatttattacatttctgataatttcaaaattaaaagaaaaaattgttaactaaataagatcctttttgtttggaataatgctagcataaaaagcttattatctttacctttgtatcggttacaatgagcattataacattgcttggacgattcaacttaatagcaaacgtgaaaggacaaccgagatcaatgatagtatcgagagacaccggagactgcagattttttcaactaaaaaaacaataacaatcatggtcgggtggtaaggaggcggacctgagatactaacatgttcaggttcgacccatctgctacggaaaattaagttatagtaattatcttagtcacctaacacggatatatgcccatgttttaggatccatttgaatatccgaagagatggtctatccgttggatgcacctccttttggggattagtctaggcttctccatggatctgggatatccctaggttaataaaaaaaaaacaatatgtttttttggtaaaataataacaaacgatagttgttgaagattaagtctaaaagcagaaacatcactaccccagtcttttagtggctatcatattagactgtaaaagacacaaatggatcttgatgtatatatatcaaattttggagctctcaaatagtggatgcgctctgttacttcttttccgccattttccgcttagaattttgagcttatagaagatcatgtaatactaaaacatttcctcaagagaataagagtaaaacttaaaaaaaaaaacagagcacccaacaaaacagaccaagtacaatgggatgagaaaaatctgtgaacaattacaacactaacgacattagtgatgtctctgactacgatgattactcgaacgctgagatcccaccgactattccagaaacatcagtctgcgatactttgctgcgaaactactctaaatgtccactaaacacattaggttcaaagaattgtgtttagagaacggcaatcctgaggcgcactatattgttcaatacttcgtccacaaagaaaaacagacaggcctctttcatctacgccaatcagccactaggaacaatggaaataatatgcatctttacgttttgttaatgcttgctgaaggtcactatcaaaccggtaaaaaatatttggataaactccaatggaaaaagaaacgatcaacctccgatcattgctgtgaaagaatcaagaactcactaagtgcaatacctgttcctatggagcagcggtactatgtaaatatggtcaaccttaagccacatacaaattgcgatcccaataacatggctaaagtatgcaagcaatgttactaattcaaaatgcttaaccaatttgtccactttgctactaataaagaatgtttattttaaaaaatttgtacaatattggttaaccacaatgtattttctaaattcgtccgtattaaaataaaaattaagtttagtaggttctattgcatatttaattttaataacttcaaaagaatgaagtagtgctctgatagaaattaaagtgacaacttaaaattgtataaaaataaaaccatcgagtccttaacaactatcaactccttaacaacttaaaattaaaataacaagttgtctaaaaaaaggaaaaaataaaaattaaaataacaatgcaactaagactaaaattgtgatgaatatataattagtataaaattagtatacgaactttgacagttcaatcaatatgtcaagcacttcaaaaacaaataaattgttttcattttacaaattgttttacttcattttatctttataaaggaaaattttgtccatttcacaaattttagctctattttaaaaattgttttcttagataaacttatttacaaaagaaaaaaacataacaatttaaaaaataaatttcacacttcaaccacttcctattccctttactcatatcccatttaaaaatgtattatgcttcggctgaaataaatgcaccgactttattttcatcttttaaaaaaaaaatctaatatattctcatctttttcataaatttaatctttcccactgtgaaaactttcacattgtacaatatcaacataagaaaactcatttaaacataccaaataaattcttaatattaataaaagattctaaatctaaaaaaaaatatctaaacctattttccacgcgtaacgcggacaaagactctagtatacatgaaatacaaagtaaacaagactctaaacacacctttatttattttgttttaaataaatcctaagaaattaagcttccactagcagtattcaacaaagttaattgacagaggttcgggctgcaaggcccaataagtaacaaacatatgaagaggccgaaaagaggtccaaataatataagctaaatccaaatcaatactgtccagcgtgaagacaacgcctgaaaaaaagaggaaaatctaaaggaagcgtataaagtgacgtgagaaatcacgaaatcactacctatatataaactgaaaccaagagagagagatccctcttctcctccttgtctccacaaaccctaaagcgctttatagtttcagtttctctcagaatcggaatcgtttgcttcagtaagttcctcttccaatcccttacttgttgatacctgtttattcgtaattaggttatgatcttttgattcggttagatgatggatgattctctcttcgtaattagggttcttatttttttcaagatccgtgttctgcaagctatagatttatctgttgacgtttgaaagtatcgattaatgcaatttcgtctttgttcgtaatcagtttgaagatcggaaaaaacaagaatgaggattggtgtttctgagccagagcaatgcggttgcgacacgtgtgtccagcatcgcactttatgcactcaagaaaccgaacctagcaaagaagtgactggctcatcggttcctgttagttcagaaccagttcaacgtctcggttccacctcagatcagtgttccggaacacatacgactccactcgctcctcctgaaccagcagcgcagtctgttgatgcatcctccacatcatcctccatattcagttctgttagttcccaaccagcgcgagctctttgtcccaccggttcactgccagttcctttatttggttgttcatggccacgtccttgtagctgtactggttgttcactgctaggtccttctattcgtcgttcatctcccttctttactgcttcttccggatcatcaatctcctcgtcaaggcaagccaacgttacaaacagtttcggttccgctgcatccgaaccatctgtatctgggccaatgaaagctcctatttttacttctggctcttcaaccgcttccacatcctcaactctaccttcattagttactccctcggacattacaagaggatcagtgcaagcgcctgtccaagctaacacttccaagactgcttctgattttcatccacctaacgttgccaacactggagtttgcgctgcttcaaggactagcacgaacaatccatttccaggatttagtgttgattacttgcccagatgtccctctaacctttctcgaccaaacgcaccaactactacaccagttcctggccctagttcagttttggctggtggtgaaactgaacaaggtagtaggtatcctcgttatgcgcctacaccagatgttgacggcaagcagattatttccatatctgcttccaactcacatggacataaaagtcatgaagagttgaggtgggaagattacaaaaatggagacaaaggtaaactaactcacttactcaaatctttaaatacataacgtattatagcattttatcttttagatctctctgtaattgactaatctcatgttgcaggtggggttgggaggtttcatccggctcacaaacctcgtaaagaatcgaggtgggataaagaaaaaaatggagacaaaggtaacttaactaactcactactcagatgtttaatagcattttctgttttagatctctctctctaattgactactctcatgttgcagctggggttgggtcgtttcctcctcctgatcatacaccgtcggtgtttactcctccaagcatacctgatcgtcctcggatgagaactattgatctaacgaaccgagacacgagtggttttcctattggctacaacacccccgctgctttccagagcccccatgaacccgttggtgtttcttccccagcatcaggatgcacagcgtgtggagccgcgagtagctcctctccttcgagtcacttgggcttgaacagtaccacaaatcctccatcatctgcgacatctcttcccgggctgttcttttccacctatggttcttttcctttgctgtttgcaacaccaaatcttgcagcttatggtacaactccagcagtccaagcctatcctatgatgtttggaataccaaatcttgctgctcaaggtacagcaactccatcagttcaagcgtatcctatgatatttggaataccaaatcttgctgctcaaggtacaacagcaactccagcttttcaagcgtatcctatgatatttggaataccaaatgttgctgctcaaggtacaacaacaacaactccagcggctcaagcgtatcctatgatgtttggaataccaaatcttgctgctcaaggtacaacaactccagcggctcagccctatcctacgatgtttggaacaccaagtcttgctgctcaaggtacaacaacagctccagcagttcagccctatcctacgatgtatggtacaccaaattttgtagctcaaggtatgactccagcagctcaggcctatcccgttaatggttcaagtcttctcccatttgccgccatgagtctgcagtaatcgtgcctcgctctgcatcaaagttgtgtcttcttttatcttgtagttctaaggtctttgttttgcttaagagtcataaatcaagtctcgtccaactttatgaatttttttttctaagtaaagattcagctaatcatggatgtaaacaagtctcttaaaacatcattattttgcttttatcaataaaagctcctttccttctactgtaatttttctctcctctgttctaataaacaaaaaacaacaaaaagaatcatgttctttgttatctctcactaagccatgcctcaacatgaacacatgttgcaaaggcatactgagaaactttacaaaaacaaactgcaaaactctattctctgatctatcccaaccgcacaatcaacacaatatccgagaaaaataaaatttcatgaacatatgttcttgtcaacgcaagctactgtccaagtaacacttccacatcctttagcttcggtggttgtagggcatttgttgcaaggattttggaactgaacaaggtagtatatgtcctcgttatgcagctacactggaaggacgtaacacatgtaactgcttccaactctcatggacataaaagttaaggagagtatgaagtagaaagattacataaaagggaaacaaaggtagctgactataactaaagatttaacaacttaaaagaaaagaactcttttccttctactatatgttctcttatgtcctatgattttgtgaaacaacaaagaacacacaaaaatgtgtggcatgaatcattgctacactctccattcccaatcctctgtttttgtgttttcagacatccaagttacaaatgcgttaaaattatgattttctcttcaagtgaaatcatctgatgatttcatattttacatattccttctcatgtggggtttatagagggatattttatgctgaatctccccctctctttagtgctaattgttgaatcattagaaaactgcaactcacagatacggagtaatgtccaaaacaaacatagatgctgcattaacattacaaatattaagttcgtctacttcatttgatacacggttaatcattttaatatctaaagataatacttcaaacacggcgattttatttactacccaataaaaatgttagcggagttaatgttcaccacaaataaaaatttattatcaatcctatacgataactatttgtttatctcctctttctcaagcatatatatacttttatatgcacatttacagtatacattatttaaaattaaaacaagaggtaaactacaaaccgaacttatgtccaacatgaaaagttttttcaacttccatgaatcaatcgcatcacacttagatactgtagcattgacaccggtagcaaatacatcacatatcacatgcatttcaaattatagaacaaacatataaaaaagttagattgtggataaacaatccgctcgtagggcagctttgattttagagagatttcctagtgctattcttacagcttgccatactaattaatgttcccctttgctactgatagtatatagtagtatactaaatttctaagaaggttaaactttcattattattcaggaggttcagcccgtaaggcccataactaagaaacacatagagagcccaagtccactagacacttaatttagctatttcaaatcaatttaaaaagaagattataagaaacgtccggcgtgaaatcaacgcctgaaagaaagaaagaaaagaaaaaaaaatctggaagaagcgtacaagcgacgtggggaaatcacgaaatcattacctatataaactgaaaaagcagagagatcccctcttcatctcatccctctaccgagtctctctacaaaccctaaagctcgatttcaagtttctcagactccgaatcgttaccaaagtaagtgccctttctatctctcatctcttcctttaatactttgcagaatttgatttcttttccgccaaaagttctgatctttgttgaatactggttagccctttattcgtaattaaagttctgatctttgatttgggtttagatgatgatattacctcttcgtaattagggttctgagtttttgtttttttttttgtttttgataatatctgcgttgcctctgttgcaagtaattagggttctgagtttttctttttaataagctatcgattatctgttgatcgattttaatataaatttcgtctttgtttggtattagtttgaagatcgagaaacaagaatgaggattgatgtttctgagccagagctatgcggttgcgacacttgtgtccagcatcggactttcattactcaagaaaccgagccgagcaaagaagtgattggctcatcggttcctgttagttccgaaccagttcaacctcttggttccacctcagatgagagttcaggaacagagacgactccactcgctcctcctccagtcaccacaccggttaataatcctgaaccagcagcgcagtctgttggctcaaccatcccacctgctgttacaccagttagttccgaacaaccagcacaagctcttggttccacctcggatcaaagttccggtacagagaccactccactcgctcctcctatcaccacgtcggttaagtctgttgactcgaccatcttcttcaagttcccaccggtacaagcacaagctcttgcccctactgcttccggttcaacgcaagcccctgcttttggttttggtgcattcgctgctcgcgtaccatctgccacctccggttgttcagcatttagtttcgcccctcctgttacatcggcaccagtgcaagctctaggcacaaccactactactactactactacatccgcggccgctcctgcatctccatttcacagttcctcaccaaccacattccaattccctcctgcttttacatcccttgctgcttctacttttccttctgttgcatcatcaacttcatctccacttgatgctcctccctcaccatttagatggggatcactgcaagctaacacttccccaccctttagcttcttgccagcgcaaggttctgacaagactggttctgcttttactccaccgtttggctaccctggtggttttgccagacctgatgttggtgtctctcatccagggtttggtccctctaaccattttggaccaaacgcaccaactactacacctgttcctgttcgcagtccatttttggctggtggtggaactgaacaaggtagtaggtatcctcgttattcacctacaccagatgttgacggcaggctgataatgtccatatctgcttccaactcacatggacataaaagtcatgaagaattgaggtgggaagattacaaaaatggagacaaaggtaaactactcacttactcaaatctttagtacataatgtatagctttttatgttttagatctctctgtaattaactaatttcatgttgcaggtgggtttgggtggtttcctcctgttcatacatctcccttttcctcaccaacggtatcaccgtcgctatttgctcctccaagcatacctaatcgtcctcagatgagaactattgatctaacgaaccgagacatgtgtggttttcctattggctacaacacccccgctgctttccagagaccccctgaacccgctggtgtttcttccccagcatctggatgcacagcgtgtggagccacgagtaggtcctctccttctagtcacttgggcttgaacaataccacaaatcctccatcagctgcgacatctcttcccgggatgttcttttctacctatggttcttgtcctttgctgtttggctcaccaaatcttgcaacttatggtacaacagcaattccagcagtccaagcctatgctattatgtttggggctccaaattttacttctcaaggtacaacggcaactccagcttttcaagcctttcctattatgtttgggactccaaatcttgctgctcaaggtactacaagagctccagctgttcaagcctatcctacgatgtttggcacgccaaatattggagttcaaggttcaactccagcagctcaaacctatcctttgatgtttggcaccccaaatcttgctgctcaaggtacaacaaatattggagctcgaggtacaactccagcagctcaagcctatccgttgatgtttggcaccccaaatcttgctgctcaaggtacaacaactccagcagttcagtcctatcctacgatgtttggaacaccaaatctagctggtcaaagtacaacaacaactcgagcaggtcagccatatcctacgacgtttgctgttcctcaagctgcgacagctccagcagttcagccgtatgctatgatgtttggtacaccaagtctcggagctcaagatatcactccaggaggtcaagcctatcccgctcatggtttaactctcccattcgccgccatgagtctgcagtaattgctcctcgctctgcatcaaactcgtgtcttttatcttgtagttctaaggtctttgttttttccttaaagagtcataaaccaagcgtcgtccaactttgtgattttcagctatccatggatgtaaacaagtctcgtgtcttttatcttttagttctaatatctatctttttaaaacacaaacattatgttggacctaacatttattttgtaagtttttaaattaaatacacatttatactttatacttaaacatatattaagttactaatatttctttctttatactactatccatgtttccaaacaatatatttatttctttatactactatcaatgtttccaaacaatatatttttatactactatcaatgtttccaaataatacaataattaatcttagttattttatatctatcattttctctttaaaattttgtaaaaacgtcataatttcataaattacaaaatagtgaactttaaaatttcgattataaaattacaaattatgaaactattacaatttaaatccaattagattacatatcggtcatccatcagttcaatcggttagtctcgggttttagtgattttttaatatgaatattttaaaaacataaattgaattgtcagatctccggattaaccggtataatcacaatcgggttgaatttaaaaatactgatttaaatgcaaaaatattttaaatacacactctttaaaaataaccaaaatatttgttaaattattagtgaaatttttcatcgtaaaatataccgcgcttcaaaagcgcgggtcaaaatctagtttctcgttaaactcgctgctcaaaataaattttcatgaacctattttcttgtcaacgcaagcaactgtccaagctatttttatattacatgttctttctctgggttgttacaacactatcattttgatattctttttgaatgaatagaaaaaccaaaggtgggaagtttacaactttgtcaactctataattgtgttattaaggattccattccgctaacaattttagtttgcataatagttttttctctgaactggtacaacaccagtaaacaaatgattgtcttctaaatcgcaggactaagtctctgttctcctacattgactctaattaaacaaatgtgtcaacttgatgatttttacttggtaaagacatctaccaatcattgatgaaaacaataacatttcatgcacattattcctctgaattagtacaacatctttctttagtaattcttttgaataatattcaacaagaagaaaactccttttctttctactataaagtctctatcattctctcatgcagaacgcacacacaaaataaaatggcaagaatcataactacactctctacacctctgtttttcttcttcctcttctccctgctctctcaccaaaccatttctcaacccgaacacttgactactttctgcaacccttccgacaacttcacacaaaccagttcatacgaagcaaaccgagaccttctactctcctctctccgcgtcagttcctccctcggaacctattcaaacgccacagtcggtcgtagtcccaacacagtccacggcatgttcctctgcagaggagacaccaccgcagcgtcttgctcagactgcgtccagaccgctacaatcgagatcgctacaaactgtactcttaacaaagaagcggtcatatactacgaagagtgcatggttcggtactctaatgtttccttcttctctgttcttgaggtcagaccgagcatcgtcctttactctcttcgctctgctccaaactcgaatacgctcaatgaaacgttagctgataaattcaaccaactgattctcaacgtgtcttcgtcctctttggttccgtattttctggaagatcaagaacttgtgactcaagcagagggttcttataagtttgagtcaatggttcagtgtagtcctggtcttgaccggttcaactgtaccgtttgtctcagatttgcgctcttaagagtttcaacttgttgcggttcaccaagttctgctctgatctttactcctaaatgtcttttgaggtatcaaacctctgttttgtcgtcgccgccaccgttgcctccatcctctccacctcctctatcgttgccgccgcctccaccgtcaccggctctatttttaccgcctcctggtttatcgcaaccgccaccaccgccgctggttttcacgcggccacagagcagcgggtcgttttctaacgttattaaaggtgatcatatttttgtatgtatttttgtttagttttgatcatatgactttctttttcaaaaaatttgatcatatgagtatctttttgatataatgtttatgtatccaactacaaatattattgacagggttggctctaattttattccattttttttgtggcaggaaaccaaatatttgggagaattgctatgacgatggcagttttggtgtttgcacttgtgaatttgtgaacacatttgatgattttggattgaaataatttgcaattccttttatgtttgtcatgtgttgttgttgtcttcttaagatcaaaagccacaaagtatgtgaatattgaaaatcatgtttcttttttgaacatttaaccatgttgattttgaacatctaatcattttgatgtttgtttgcatttgatcaacaaaagaagaagagttggaggctgatatatcaaattataattaatttctgttttacatactcttttgctatatcaatacttttaattttccagcatgaccaattgataactgtttagtccatttatttataatcatgttttcctaataattaactgccaatatttaacatatagatatctgcaaagacatattagattataactgctactacaccactacacattttaagattatcacgaaaacaacttctgtttttgaatgtttaaaaaaatcaaacacacgcacaaatatattaatatgctatacaaattcttatataaaattatggttttatggtatgtgttatactttagcataactgtatgtatataaatatatatgtatattatttatagtttgtattgcaatatttttaataaactaaacaattattatatttaaaatttaaaataaatcttcaatttgtattcataaatttatgattagaaagttaataataaaatagtaataattaatttcagacatatttacagaaagtttaaaaaaatcaaacacacgcagaaatatattaatatgctatacaaattcttatataaaattatggttttatggtatgtgttatactttagcataactgtatgtatataaatatatatgtatattatttatagtttgtattgcaatatttttaataaactaaacaattattatatttaaaatttaaaataaatcttcaatttgtattcataaatttatgattagaaagttaataataaaatagtaataattaatttcagacatatttacagaaaaaatacaaaacaacactatatatgcgcttcaagtacagatcaagatttaatataggtctaacattttaccggacccgaaaaaccaaactagaacggatctgaaaatacaggttcagattcgagtttatgctaaaatatttattggattttttttatggagatccacaagtctcggtttggatctacgtcctacaagagacccaatcaggtattcgaaatactcaaaaattattatatattaggtaaatttggatgattgtgtgtattttagatatttcagatatttttttaaatttcggattcaggtttttaggtataatttcaggtttcgggtaaattttagatttccaaaaaatataatttgggtgttcgggtaaaatttgagatacctttcgagttttcggatctgattttgtgtaagtttcgatatattttctccatgtatttttaggatttgcaggtactttttgagttttcaaattcagtttggatatgtcaggtttttttcgggtcctatatacccaaatcaacccgaatccgaaataaaactgaaattatgaatgttttacgtatattagaattatatacttgaaccgacaagagttcgacaagctcctggccgagcagacctaaaaaactatagatatctatatggatctagatcttcaggaaccgaaagatgcggacccaataagacttgatccgaggaccggatgcctaggcctaatctgaatagataaatatgattacaaaaaatagatttatagttataaagaaacgagtatatgccggccaactttaaattactattatttctacagtaaatcaaataggttttgattaagatttatacacatatatgactacaacaaaatatgattaagaaaaaaacacaagtattacaattaaatatctagaaaaagttaaacaaaaaatatacatgtctttttgaaagggcgggtcagaatctagattctgaaaacccgaatgttctcaaatatttaaaaaaatagtttcatttaaaataaaaaatcatataaactttttaaaatacataaaaacagattttatcaatacataacgggtctatgacaaaaaaaacagtttaaaaatattaaactttttctttaaattaaaatactaaaaataaaatcactgtgaaataattcacaagtttaacagcaggttaataaacaaaaatcataaaatacgaatcagaattatttggagtcttcaaaatttttgtcatatttaaaataacaaaaattattcatacaataattttagataaatttcataaaattcttaacaaaatataatttatcaagtataaaaatattcatgacataaaattaatattttcaacaaaaatatacctgcagaatctagtgtactaattaaatctgcataattacccttagtgtctatttttttaaaagaaatcagcatgcaacaaaaattcgttggtagatggactgattcgcaacgaatacatcacaaaatcttagtttgcagttttacgctaagcaattatcaaactaaaacatctaatctagtggtctcatgcataaatgcatactgttaaatattgaatgacggtttaccaaataaaaagttatgcggtcgtcgatatcatactgatatttcaagttaagataactgttttttttaaagcacacttgtttttagggtttatcaacttatcattctgtaagcgcaatatgtacatatattagcatactcggtcaatgttatatgttttcattgttaaatgcagtcttctccttccttcgtttgggcatagtatttaacttttattagtattatagtttatcctagtgaacccaattaaagtaagtttgatagatgtcaacccttttaagttgcttaaactaatcaacacttgaaagttcgtcacgaaataatccaatacctatcttttgagtgttgcagccatgctagtttggctcagatcatcttgtcatgtataatctccgctttgcaaccgagtctgggcgttataaatggttagtagacaaattcttttatgcaatgcaatatatatatgcggatactgatatattgactctgcactggctctaaattttaggttacataccttatccggaatcatttgatatacaacttatcgctttgtactaccattttggattttgtgactggctgacccgtttctgttagtcttgcctcaccctgtatgtgagatgtggaataagcaacttattaaacccaaacactaatattttggcttattttatattgcaggaatcgaaatatattggagaattttcattacagccatggcaacttgggtgttggcacttgtgggtctatgatataaagttttatttatatttgtattccacaattgtatgtgccgctattttcttgtatagttaataagaagcaacatacttgttttctaagttatctcaaaaaagtttgacgttcgatatgtttactaaataaaatcctaatgcatcaccatataccttctttactgtaagaatgaatcgtccaaaaacaactctgtgtttcagacaacaaatgtgtcaacttcatgtttttattagcttcatatggtttaaaataatagccagccggaaggctgcttaacggaaccaaaagctattatgacagaaaaaaacaggtgaaagaggagttaacatcttgcacaagtgattaacgaagtcttatttgcttgagagatcaaggattgaaaccttgattttgcaaatttattgctcttcaatataacatcaaaataacagaaaatcttgccattactatgttttcaaaggcttacatacaaaagagaaaaaaaaagcttatcaaatgagaaacgttaaggaatatggcacagattaaacgttccccttagtgtgagctcaatctatttgcgtacgtggcaagtatttcaaggaacactgtttttggttatggcttttcaaaacaattgttgcttaggtctagggcttaccattgccaattttatgtggaaatgctgaagataaaaccaaagcgtaaattggcgtaaccacttcttttactgctgtatctgcctgctacaatgaatgtttgatgttcatagaaaattaagggaaacagaggagggacgctctaaaaagttcctactaaattaacatgtaatccaaccttcaaaacacacttgtctttattctttacattgttaaagcaatcaatacattttcgtttaattctccttggaaatggttggcttctccatgaacttggagacaaccataccaatagcaaagacgagaggccacactgatactttgacaggaccgtctcgtcccctgtcagtaaagctacaattgatcgtggacactattaactgaccaacaccgcagaaaaacaagatagcatccgtggaacttccaaagattctgttgtagccacgtggtgatggatagtagaaccaaggaaaaggcaacttgcaacggaaacgagctttatgggctcgggttttgtaagagaagtcaaggatagataggataagagaaagagttgacatgactaacgagatcaattgaaggaagacagacaaacaaacaagtttaggaggtgttccccggctatgatgcccacataggttaaagcttgtctccatctttgctaccacgacatgtttccttgaaagctttcccgaaatctccagtctgtttcctaacatcggatggatctactccgtagaaaactgtcgtcacgatttgttccttgcacttcaaaatctccagcaggtttttcaaacaccagctggaagaagcataattcttggaaagcaccacgatcgatatcactgatcccctaatagcttggcctctctcagtcccttgatcatcgaacattaaaatccccttgctgtttaactgtctccgcaaatgactgataaaagtcttagggacgtcgggtccgtagaaactcgcaaagagttggtagctccaagtgcgagtcctaaaagaagaagaagaagaagccatgggataaagtattagctagggagagagggttacaagatcagatatacccaaaaaaaaagtctggggataagccatatatgatccagaaagcgccagtgttcactgtttaataaaagaccgaacaagggttttttggcattttcagtagccaacaaacttctttgctctttctcaaaagtgtacaagacttccttgcacttcaagtctctccaacagctctatataagctccatatccatgaagcattgttctttgagagcacaaacgatcaaatatcttcgactagtttttaggagcagagaagagcgggcatcttcgctttagttccataatagaaacatcaaaatcttatagaaaacctcaaaagcttacgtggacggcattaagttaacacttggtatttttagttaattaggttttacatagaagaagaacagacatcgtatgctttttagttacacaattagctactaaacaccaacagctcagattcattctcaaatcttcctcccccccccccgtcctgatgaaccttgagtgagtcttcaccgccttctgttgagtggtttcattgaagttgaagtgctaatcgtcggtcttttagcacctgaggccaatcaacaaaaggttagatgactcacgcagcaagattgacactaaagaccatataatgagatttccattgtgatgcaaactaaagaagacatccatatgcatagtttacacaaaagatcatagaatgtaactatgcataacgatttggtttttaggatacaagttactatgcaaaaaagagcttatgttacttgttaaggtcttcgaggaggagctagtggcaattgacagacgagaaggtctggtggtttggcctggtggtttcaagatctgcttcggaatcttcgatggaatactagttctgcttttaaaaataccaaaacaaaacaaacataagaatctaaaaaaatatgtattcatattgttctgttaaagtgtgctagtagagggtacttacttgtctttgggcacggttttcaccatctttgctgatttctcgagcttctcagggaccaagtgtggttcaggttcttccgttatttcaagaggcttcacggtttcagggaaaagagtcaactcgactgcactgcatatggagccatcagtttctgttcccatcgaaagacagctatcagagatatcactcaatctgtcctcagaatctgcatccccaaggccaatgagttcaatgtcatcttcaatgtcaatttcttttgacccaccggcaaacttagatagctggtgaagatcctttcgatgtttaagttcgtccgatgaacgcggtgaaccggaatcagaatgcttgctactgtattctgagcagttgtcaaaatctgaggctgctctcccaaaagaaccaggtgcctttcctcgtcgagcatttggtgaaggtcctatagagtgtcttctaggtgatgaaggccccaacaatcttagattgcttaaaccacgtttcggcacggttgtactgttacttttttgcttctgaacattttgaagctcttcatctttcttggcaataacatccttcaagcttgatacctgttacatcaaatggtatcaagataagtataactttgttctctatttacttccaatgggcaagattaaattttgagagagatagaaagaaaataagcacctgttccatgaggtgtctaacatctcgtccctctttattacttttagctgcacctaattccacaccagaaactctttcagcgaacttcagagtgctaaccgtctcagcataagaatctccatcaggattgacttgaacaaacataagagtcttagcctgtcctcctacaagacaaaacaaaaaagtcaagacaaagggttaaggaaccatcaacataaagccaacgggtatatcatgcaatacgtgtagcccaaatcttaaaactttttcttcaaagagggttaagaaagtacccaaagaactttgaaggacttgcgtcaatttgctgtttctatacggcacatgggggttcttatgcgctagagcaaatatgacatctccaagggctgacagtgatttatttatatgctgagcctccttgagcctctctccagttacctccgagcgatcgaccctctcacttccagcaagatcgaccaagtgcaaactaccacgcaaaacagaatcggtttccacgtcgacaccacgtacatgaacagaaagaacgctgtatacaataggcaacaatgtcatttctataatcctgaggaagcgaggcttagataatgtcagaagataaaaaaatttacaaaccagtgtgatctactactcctttcattgagagctgtggcaccaacggttctgttcatgagcccaatattcatcagctcaagcacatcttcagttgatctcacagaatgcatgcttgcatctgggacagctaacccatttggtaaggcagtattccaaacccctaatgtacgcaagttaaggaaattttctatggaagcagcatatgcaaacatatagataaatatgtaagcatatgtgaatgtacatattccaagtaaaatttagcaacaatattagcttagagaaggatatcttcgattagaaccaccatcagaaagtatgtcacgaacttgctcattgtatatctcaaccatttgaacacctacttcatacacaacagtgttttgtctaagctgagttaagtgaaacaagtcattcagagctctgtaattgacaccccagtgttcttttgaagtgatgcttggcccactctgtgttagcaaaatggaaatatgtgcgttagagagtaataatgtttggctgaaacataaaaggagcaaagtcaagcatggcgtttaccattgtataagtttttccagatcccgtctgaccatacgcaaatatacacacattataaccatcaagaattgatcgaattaatggtcgagtatctaggaaaacctcctctgcattaaaaaaaaacagatttaggagaaattaatattacataaagtccttaacaagctaatctatatacataagaggaaggaggtttagaccttgagttgctgcttgaccgaaaactttattgaacttaaacaaccgatgggtatctttcccttgcttaaacggatttgcaaccaccaattcaccgttctcaccaatgtactctatagaagtctgtccactgttttgccccggaaggaatggtcttatccggcaatagactctgatatttcctggaaaataaatgcaagagaagaacagagtcatatctttaatggtcgagtgcaaacccaaagtacactaacccaaagtgttttacctttcaattcctgcacttcattgtacagtcttcggttttcttcaaggaccacatggtaattttttgctgcatcagccactcctttgagctttaaaccttggaaaaatattacaaatatgaagccatgtatttcagactagaaaaactgaccaaacagccatacaaaattggtgacataaatgatacttaccatagtaatttaggtcctcaaagtatttcttttgtgtccttaagacttcttgctttatagacactgaagtagcattcaaagccttcatgattcacaaaaactatgtcatttaaaagaactaccagggtatttattgtttagaatactatattttaaagccaaacctgcaaagcaccaaactggttgtctatgaagctttggtaggtggactctctgttctcccatttttgagatttagataggtacaacttctcgagttctttgaccttcctagttgattcggcaacttgtaactctgcatcctttaatttactctccaactcaactgtactgttttgtgcttttgcttctaactccaagcactggtttgcatgcgcctctttcaccaccttgagttcttgcttcagcttacgaatctcagcatcactgcgctctttttcctttttcaaacgcaccacatctttttcttctgacttttctctttcttctattctgcttttttcaagctaaagagcacaacaaacccattattgggaaaactctgagctaaaataatttaatacacaacacaagcggaatgaaaatcgatgcatgagtcacgtatttaagtaaaaggggcatacacaacgacttatgatataatttcaacatctagaggattggcttaaacgtcaattttcacaagtactatgcaggttaagtatgtattaaggagacgatacatattgaatcaataacatacctttgtacgctccatacaattcgaaacaatctacaacaaagaaaataacagaaagaccaatcaataagcgaaatagaaataaactgaaatcagagacaacagtacctcgttttcctgagttgccccagctgccaaggtttctaagacctttattcttgacctgtatttatcttcacgtaccctgaagagtatattttgctgcacatatcataaacatgtttcattacttggtcagaaggattatattaacacgtgcatacaaagaaaaaaagagtattatgtactcttacgtttttcaggttatcagcttgatttgagattctctgttctatcacttgcacaagtgcgctcaagagtgatgccattgcctgaacaacaaaccgcaaaagggagaaacatgtggatcataagaagaaatgttccatgaactaaggattcaaattttaggcaaaccagattaaagttatcaagagaaggaaggcatcagtagctaaatctttgtcttacatgagacacatgtccattcatcttcttcacgctctcatctagaagtttatccagcatgtcaaatagtgtccgagtaggagcattctacaaacaaagggataaagggataaaagctaaacggttgtacacagtctactaaaaataagttagaatactttactcgtaaactgtcagatttcagtaattctgaaattttagcatctgatgtatcaatctcaaatccttccttcgactggaatccatcaataaagttgcggtcatctcctctggaatccgaatggtcttctggcaagctccatctcctcctcgcacctagtgagtttttatcattaccaccatcggaaaaacttgctttaagggccttaagggactgaaaaactggcagcatatccccctgcatttttactttctattaggaggcataactccataaagaaagacgagagacggcagagagaagaaaatatatgggggcaaaaatcatggaatcttatcaagaatagcaaatcagacaatagccatgatgagaacagcgttgcagccagatgatgtcaaaaacaaggcttgttttaactgttaacaaaaattatctaccctgaattggttcggttttataaaagccaaggtggtaaacccacaatctctttacctatgtgatgcaataatactatataaaccaaccaaccagatgttctctaattttcaaatcattttttctacagaaacgaaaagttatatccatagaacaaaacaaacctgttctatgtctgaaacctcgaatctgggcagggccatttcatccatagcagtcagaaaccgctcaactctaacataagcaggctcaaagctgcctccctatagaatagccaaagagtgtgagtcttagcagaaaaataaaaaatagagaaaaataaaaacagaagcttagcaccaaaaaaagatatataagccaaatggtcaacaaaataaaaattcataagtataccattctcattgaaccaggactaagctgattcaaaaggttacacaagacagttccatccctcaagcatgctctcacttcgtcctccgaagcttccgatggtaaattcaaataaggaagtgtctgatttaaccattccaccaaattctgatgacctgagggcaacaaaatgaagaagaaatatacaagaacggtgagaacagaagccatcttccattcatgtctacacctaaaatgagcttaaacttcgccattttcttataatcacatgaataatctctgtcattactcaaagttctgagagataaatacaagaaaaagggaatagatgacgacatttacctttcttactaccatccaagcttgaacgactttcagacccgtcgaagctgagaaaactagttacatcggagggagcatagacgccactcatattggcgtcctgttcgagattaatgttcattccaactcagagatcacgctcagttcccatgattgtagttgagaggaggagaccctaaagcaactaagaaagttttgtcaataaaaacaacacaaacgtactaattcgccgtgtaaaatattgaaaaaggggctcccttcatcaatctaaccttctaatataatcaaactaagacgtttcaatttcagataagaccgtttaaaattataatcaatgatgatgaaagttaattccccttgtgttaaccagaatgcggaccaaatcaattacgcagatccaagccatgaaaagagaattaaaggatacgaacctgagaaaagctaatagataaagctctggagggtggaagcaacgcaaaagaaaaaaaaatggcgactggtactgaaggaaaatgctgagattcacggcgaggaaggggagagaaggcgtttgaatctcctcgccgggagagaaatttcgaatttttccagccgcagcgattttgctcactcttttcctcctttcttttctcgtctcttcctttttttttagattccgagaaaaaacaaatgctaattacggttccaacttcgaaaatagagaaaaatgttttttcttttccttagaattaattttaaaaaaaaaacatttacaatacaatttatgtttgattttgctttacgttatagatgttttggtgggccctacccttttttcagaaaaggctcttcccgctttcctcactccaaaatttttatataaattttttacataaatatccgattgattatgcggcccaattaagcccacgtataagcccgtttaacttaaaatgtccttcaacttgttgatcattctacctaaattttcatgtctgttctttatatttgtttactaggataatatttttggtgtgtatgatgcttttttatttgatttatgaggaggaactgtagttagttataaaaatgggttaaccagctctagagtttttctttgccaaaaaaaaaaagctgaaaattatgaattatgaatctgcttagcttcgatcaaaccaacgaggcatagttatgacatgggctttaaccgtgctttatatattcactgatgagaagaagcaaccctcaatatgccaaacgtgtctgttgcggagaggaagtctcagcttatgtgatccatattgataatttgatatggcccaaacatttgattaaaggacatacagaggtaccatatatagtatcattttcttaatacttttatgttttcatgcatttgggggaagggtgtgataattgtatgaaacaaccttaaccacagttcacgaaagagttaaagcctacgttagagaaaatatctaagagagaccttcgttatcttttgttatagtactttgtaacatacataaaacatagtacactgtacgtattattctctatatcaaattcatcttgcacttgcactttcaattgatatcagagagaatcactgaaatcactggtaagatcttgaagacaaaatagatgatgtagtacagtaggaagcatggtcattgaaattgttagtgcaccaaaaacagaattttagaagttaaaataaaaaaattactcaaggtgttcaaatacctttttttttgtgcacttttcatttaccagtcttaaaatactacataaattagtacaagaagtatactacaggaagcgaagatgtttaattgacttgaagactagaattggagccggcctaaagttgaactagaagttacttagagaccatacaatcaaagatttactttggagaaaaagaaactcatcaatggaaatttttcaaaaggctttgaataagatttggaaaaactataaaggagatttgtggaaatttatcctttggatagttagctatggtgagtcaagaaatctacggagtataattatgtactagatgtttgtccgcgacttcgcggatgataatattatatgaaaagtacatgttatgtttataacgttatagtgttataatagttgaatagtaattagaaattttaaattttagaatttaatgttgacaatttttttttagaatttaatagtttgataatcaaaaatttcagtatatatttttagaagagctgtgaagttttgagatagttcaacaacaaaaatgtgtcacaaaaatatttttcttaattgcaagtattgttacaattgatttaagtaattggttttaaatttccttttagtttattttaacatgtgaaaaaacaaaaaaaaaacattttagccataaaaatatattttgtgtagttccaaaaatatggttagaggtctctatagttctgacatcttctttgatgattttttatgtttctctttgtttgtatgattgttttcaatttattttaaattcagcaaaaaataattgttttatgtgtttctttcaaaaaatctggcaaaataaaagttcggatgtaactaaaaactcagatttattttataaatgagttaggtagtctttccgtttcaaaatgttacatgttttgtattttcttaataattgtgtaaaaaccttaaacatcacttaaaatgatacagagggagtattaaatttaagtattaaatgcataactttcagtgattatcgatttttcatgattctaaccaataagaaatcagtaaatgtaattaattttttttgaaattctcaattaatcattattaattgataacaattgtattgaaaatataaaccaatgtatctttctgaaacaaaatttttttcttagaatatgtatctttatgaaatggaggaaatattaaacagtatgtaaatcaaaagtctatagataattgattgtaaaactaatttttattttaacactctaaaattattaaaaactaaaatatcaactattgaaattgtaagatttcaccaatgaatgtatatgtaacaaaaaatcatttgggttatttatattttaatatataaataaacagtgtgttataattttatatgatttaaatgacttatttatttttaagcataaaacgataagtcacttattatattttaatagataagatataattgtgcgataatttatatgatttttaaatcattataaatgtacatttatacagttataattagatctagaaacatttaccattttgcatctaaacaagatatgctcaagatttatatgaataattttgataaaagtcttaaatgattcagaaactctaataaaatgattttataggccaaagttaaaaaaatgttttaaagtaatttcaaaatatttgtaaatgatttataaatcttgtgtgggttttaaaaaacaaaaacaattataataatgctctatatacaaatctaagtttttatataaaaatatataaaaatattttaaataattataacaataaattataaagaaaaaaaattgacgaaatattatatattctttatataattatgcaattagtgaccataaactattatttgtaatattacttgtgttttttagtaacttgcattaattgattctagaattttcttttatttttagatttgaataaaataaatatttaataaaagttatcaaccaatcaaactataacaatttcttgaaacttcacatatgattgacacgtcagtaaagtgacttctcaattaatatatatagggataagtgtgtcttgtatcgatatcatttagggatattaaaatgagtttccttaatgggttttaaatggggttttaatataaataaatgcacatttacacccatttagtttatgtgatttaaatgggtagttttgttaagacacatttattaaatggtgtttcacttaaaattagtggtgatcctattaacccatttaacttaatacatactccctctgttttttaaagatgtatgttttggtgttttcacacatattaagaaaacacattaattatacatcatttttagaaattatcaaattccaatgcattttaaccaatagtctttcaataaattcaatcaattttattgaaatttgcaattttgtataggaaacataaaaaaatacatctttgtgaaacaatttatttttctaaaacatctatctttaaaaaacagagggagtatttattaattcgattttgtgtttttggcggaaaacttgattttgtgttttgactagaaacacacaattttacggttatgacatgaagtaatgattttgcggcagaaaaacgtgattttgtggtttcggcgggaattttgatttttcggtttttgtgagaaaattagattttgcggttttttgtgagaaaagcttgatttcaattttgacggaaaacataattttgtggtgggaaaataaatttttcttattttgtcggaaaatgtaattttacggatttcgcaggaaaatgagagtttactgttttagtgagaaacatgattatgtggttttagcgagaaaaatcaattttaaccatgttctttttgtaaaatggcggcagcgtcccgcgtcttaaaaatacacttgatcttgaatgaatcattcctttcgctgtttattgattaagacgctaacagtacggccaattaaaattaacggggatttgtgacgctgtaaaatccagcgtcagaataaatggagatgcggtggttttttatgaaacgcagaagcatcaatcaaacgaggatgccttaaaaagctgtttcctttgtattttttttaacgccgaacgctgccgctgcgtctaaaaaagaacagagatttgtgtttttagcaagaaaatccaattttgtggttttcgtacaaaattttgattttgaggttttggctggaaaatctgattgtattgtttttttgtgggaagtttaattttgcagatttggcggagaaaagaaattttgtgttttggtagaaaaacatgattatgtgcttttggtgagaaaatctgattttgtgttttggcaggaaaataattttgtggtttttgaagaaaaatctaattttgcctaattttgatttaatcgcttaatttccgcgttgatcgcgaaaagttgaaacacaattaattattttctactcattattgacagattttgtgttaatattcattaccaagtaattacagttagctattaaattcaaaaccattgttcaaacccaaaacatatacatactacatttgaggatttctttgtatcaaacaaacactgatctaaatgttttgacaaatcaaaaggatattgttttaaattatctataaaagtttatataattatgtctaaaaacttgtgtcatcatttttagaattagctaaacatattataaatatttaaattgtatttaaaattagacttcacgatattttggtaactcgctaggcacggttttaccactggacaagcgcctaacgcgattccgaacaaggatatatcatattaacatccctgataccaccttaatcataaggattttgggatttaatttaagttgacacaaagtataagggctaagagtttataaaggtttttgggttgtgtacctcactaccttgaacatgtttagtttaagtgtaacatgtaaaaatgggaattgaattctatgaaatctaatctctcgctgttgctcagtagttcagtggtaatagagtgattgagtgttaactaataattggtcgtagttcaacttaaactgagtaatattttttctttgttaagaatactttgattatttttggttgaattaatttgtgacataaacaaaacataatatctgtatgtgttattttatgtatcatactcatcttacacttttaattggtattaattttacaagttttaatgtacgatttacgtacgtatcttacgtaaatggacatgtgcatttttctattgttcatgttcatgcgagaactatcatccatagatcgtgcaaaagagtggtggggaaaaataacttctttataaaattataacttttaattaatgcgataaaaaggcaagagaatgtagtttcgaattaattacaccacatcatatccatcaaaatcatgaaatttagaattttttagcaccatgcacgtggacagtaattttaacggaaatcaattagtcaaacaatcaaggcacccagctgttccttatgaagaaaaacaaaagcttttgatgaaactaaaatgtcattttacagaacatatactatatagtaatagttgtagctactactgattgttgtcatgactgtttcagagtgtagaacaccatctgatataaacatgcatgcatgtatatatgttcattcaaatggtgaaatgtatttgcgtacgcataagcaaaaagacaatgaaacaagtcaaacaacacaagactatgggtctaactggtgaccacctcgggaatagtaggaacaaaaaggaaaagaattgatgggaataaaattatgggaatgatgaggaacggttattccatatcaaatttggtgaggaataaatttgttctttaattctctacaataaaaggaatgagaaggaatgaaaaggaatgactattcctaatgaatggtaaaatttgttaggaacattaaggaatgcattattcctcttcattccttggtcaccggttagaccctatatgtggattatgcatatcatatacacgtgaaaggtacctttaactatcaaattgattttgtagactccttcaaaccaatctaggtcacttcgaactgtagattatcccttacttattaatacagaagcatttttaggatataacctttattttgtattttattcacaagtttgccattataggtgatctgtcattaccatagctcttctcagctttcgtttttaataaccctttgcttactagagaaattactctatatgccattagtacacatatgacataattggcttgataacataccaatttaataagatgggtttttgttcttttgtgagatttgctcgccgatgatgtcgggtatctcgccggatatctgagtttgacgacaagtttagagctctaaggttggagagtaaagtaatcaaagtgggtaatcatcctttatcagattatctgataaatcgaaaatgtgagatttgagtggaatgttttagggatgtttacggagagattcgtgtcggagatggtgagagagacgattttttttgtgactttttcgaggatgtcaaagagacaagaggtggtggagacaggggtggaagagacagtgagatcagtgaggttaacgagacgagcgggtagagtcatgagaggccgttgcggcagcggaggaatgaagagacggcggagaaggagtggagtgcgtcagggaggcgatgtgcgagtaggtgggagcttcgaaggttactacggcagattcgttcggtcctgtcgttttgggtggtacctttgatcaattgctcaatggacatcagacttcaaggttaattgttgttttcagtctgtggtttctgcttaagaatcgaactaatttgtcgaaatatttgtttgtggtgatggagaaatcaggcggtggagatagccatggatcgaatagtagcggggtatgtgatatcccgatgttgatgaacaaacaaataagccatctctccctcttgaatctgctctcatctctcccttttcgcctagattagtttagcatcctacaccatttgatatagcaagtcattcgagaacgaggaatctagcaacttatgtgaggttgaagtctcttttatggctaaaattgattgtactgaatgtttctgtggtttaaaactgaaactgtttagctttgttgatgagctggaaagttcaaggtctcaaagacattaaagagttcaattccctgcttatgtgagattggagtttaagtccagttgccttattagttcttatcatgagttgcaaagacgtgttattgtgatctcaaggcaaaaggaagactctttttttatcgtcttatatagtgagtttgtaaagctgaaacttttatgcattggtttggcttgaattcttgctgtctgaactcactaatgtcttggcttgaattctcagcgagcttgctgtctgaactcactaatgtcttggcttgaattttcagcgagctttcgtctaccttacttgctctgtttttttcttctttcatggcagctctgtttatttttcttctccttcaacacgttaccatctaaacatggtttttaaataaatattttgcattttgttatcctttcatatatcaaaattatcaaatcgagttgtcattactaagatggtttcttccagctatacatacacatgctatagaacacgacttctttctcttcaagacatgtgttgattatactatacagtgtggttctatataattctttttaattaagatatcagtactttacagtttgattatctttctagcaagatgttacgagggtgagatattagcaattctgaaaatatgcattttcactgttgttatactcatatgtataatcgctttatcttggtcacagaataaaaatacttaaatatgaactcatacatttcattgtcaatcgtgtaatgttgcatataaaacatacgaggttatattctaatttcaaaaaagtacaaaagcaaagtcgtgagtgatcagatcattgtgaatcaggagtaaatcactatcaaaggatcaatagttatataaaccagcagcgattcacacatacataccattttcatctcattgatgctaggcctaatacatgttactttaaaaaaaaatggaaaatgaggtttggtatataatatggccttttggtaacataccgtcaatacatgcattcgttagttatgcttaaattttacggaaatattaaattgtgttcaaagtgaatttatgtgaggtgaatataattaagttgccattatgtttaggtatattctaaaacaaaatattggtattcatgtgcccagaaaatctcgctcacacaacaaagagatacacttatggtccaaatactataacgtatcaatctaaattaaaaaaaatctcaaagttgaaaaatattctgtaggaatttgataatgtattccaatttcttacacattaggtatccatatcgatgtactaatatatagaggtgttcagtctgatagaactaaccaattaaaaccaaacaaaatcgaagtagaaaaaaaagatttagatttgatagttcaaaagaagtcgagccgatgttatctttaaaaaataacaccgaaaaattgattaactaaaaaattagtatatttatatgtaatttttgtaataaaattaacattaaataatatatacaaatttattttattaatatggtattcataatcaaaacattgattaaatatttttttatttttttaagttaaaatggttattttatttttcattttcatcaaattaaataaaacatatttttgtttttattgataacttcttgtgataaaatataattatgtaataatcctttggtattattactttttacttttatttgaatatttaaataaaatatatattaatgttttaataaatctgatttatattcatataatctaatttttttaaaaataaatatatttatggtttcttggtataaaaccgaatgaaccaaaaattaatggtatataaacgaaccaaaccaaattatatataatttcaatatgatagcgaatttttataaattgaaaaatcaaaaaaaaaaaaaactgagatagtatttaattctggaggcctgattaatattataaatatttgtcattaattctctgtgtggttagtacatactatatgagcaagttatgcaatgcacctttttctgtctcatttagtttactgtagtacattttattgtacataatattgtagatgttatcaataatgtattctgcaaactataaatgaatatgtaatgtttttttagtaacaccaatgaatatgtaatgtaacttatgctattttacaatagtttcattccgcgcatagcgcaggtctctacctagttctattagtactaagtaaaccgaatacaggtgtggacgtcacattattacaagctaagcttaattggttaaagtaattaagttcggttggttttaggatttatgatagaatcatagagagtggctggtgctgacaatgttattaatgcttaattaataagctggaccaccaaaaatggactgttcgataatcaactgaagactctgatccactcaataaatgcgagcatctctttcattataaaataggttttatttatttttttggaacaaaaataggttttatttatcttcacatgttcttacatccaatgttggaatatatcattttatcttcacttatgtctgcgccatgttatttgtaacgcaaaaaaattgttctcttcactggttatagttaacataacatgtaacaaataaaaaacatgtaaaataattacatatttagctgcctaggaattgggggtatagattaaatattatttataattaaatcctttataacaaaagtcaaagtgatcctttttggagtgaaaattagaatctctctgatataaaatactttgtggatatctcaactaaaaaagttagaaaggaactgagtatctcaaaatgagggatttctcaattagatattcaccttagatacttttgcaataggattactctcttagctagaatcatgtttacttgtcctcgcgaggaccacaatgtacaaataacacggatgacatgttcatacaaaattatgaataatctgtattaggaaattactgaaaaggttattccttcaatttcacattaattgtcattctataatttaaattttgtttaattttagtactttttatgttttaatgtatttatttgttagtttttctaattttgtctatgttatttttgtttatcaattaagataagtcaaataaatactcttacatttgtgaataaatgtcactttgatatttttaacacagattaaaaaaatgacaaaaataaatataaattattattaattacacatttctgatcaataatatttgagataaataaaattatttataaaatcaatgcagtttacaattaattttcaattgaaagtaaatataatttgtattgaaattgtaaaatgatatttttgtgtaacaaaaaaattagaatgacaattattatgaaataaatggaatcaatgactcattattattttctgtacatctaaactagtgctatcatgcgctttaatgtgacggaaaagtatggcaattagtacgagaacctctaagagcattttcaacagaccctcaaatcctcaaattttaaggtttttgtttcttcaacagatccttaaatcttcaaattttgaaggcctgaatagtgaaacctcaaatttgaggttccactattcaggccctcaaaacactatttacttttcagtttagttcttataaatttgtaacttacatatatttgtactaatattaattttcttattattttaatccttgtaactatatttcacttaaatctttaaatatatcttatatatacagatatatatacatatatatacatatatattattacataaaatatgaaaatatgttaaaactaaaataaaataaataaacaaaaaatattacttaaaagatatttattatttcacaaaacatttatattaaattgaacaatatattacaaattaattttgtgttataataaattgtatttataaatattatgttttataatttcagtgtgtatgtactatctatctatgaaaaatataataatgatagttgatttatattaaagttagggactgaaatgcaaattacataaaattttaaaaataaatttgaggatccttgttggagtaacccaccttcaaaccctcattttgaggatcattggcccttaaaatgaagttccttgttggagatgctcttagagcaactttatcggcagcaaaatcacgtatcttaaagggggggaccacgtactttttgcaaaacccatgacagacgttggttaaataagagacgtttgtgctgcgtttgttaacctgtttgcggactctactgacacgtagtgatccgcgactggctcaattattattatttttttttaaatcagaaaaatgcaaaaaaaaaattaaaaataaataaattaaaaacctaacaaacgtatcaccgataatgatgccctaactgactaggggtagtatatggttcagtatgttaattcaaacacattaaagatttagaatcaaatgataaataatactatttggccgtgtaatcatacaagaaataaataaaacagtgaaaaaaaccttactcctttttcaaggttcagacacgacaagaagtagtcctagttaggggtgcttattttgagagatgcgaagattttattaaaaacatactatagcttacggtattaaatagctcttggtttcttgcacagtgttttaaatatctcatttaaatacatatttttgtcaaaactcaaacatatacaatcacagttgattctcttcctgactctaattaattttcaccaacatctttgatccaagcttcaatctctctcaatatgcaaccttattgtttgactcgcatggaacagagtctcaaataactttaggaaagtttgagcaagtgttaacattcgaaatcaatgcagaaactatatgaaatgcaagcttttttgtctgtttcccgggagatccttgatctataaccttaaatttcgtgttcttcgtcgtgtgtagccattagaatcagttatgtgtttttttttctttttaagctaccagcattaatttatattttcttgtgtatatactccgctcctaacaattaattgttgtccttttggcacatcgttaaaattggaacgaaacagaaaaaattagcataacctttgcgcaaagatgatacgcacaaataaaaaaatagtccaaatttttagttagcaaaaaaaacaattaaccgttgttgttggccaaaataagtcttggttggatttatatgaatgttatatctatattattaaatcagaagtacacatatagaatgccctttagtttttagtattatttacacttctatgccactaacgttaaataatacttcctattttaatgctgtcttttccactttgattaatgcattttctaaaattaaatttgaattaaatacacaattaaataatacttcctattttaatgctttgtattttccacttacattaatgtattttctaaaattaaatttgaattaaatatatttcattaacttttcaattaaatcaatttcaaattaaaaaaatacatttttgttggacaaacaattcatggaaattataatatcaactcttcatttaacaaatctgaacgaaaagaatattatcaaatttgaaccgaaactagatactatccaaacggatttaccattttggtatctagagaaccataaccaaaccttatctgaacgaaatatttcagagattcgaatgtatttaaatcatatttatatacttcaatatgttagctattttcgagttaatatccaatatataagttattttaagttgtttaaaatatttgaaatataaaaaatagtcgaaagtaaacatctaaagtagataaacaataatcaaaacaccaaaatacttaaaatatatatatttattattcatccaaatattcaagttaaacctattttaaatttttaatttaggtattttgacttacattactcaaatttacatgttatattttttaagatttagggatatttaaagatatataaatttaaaaaatttaaaaataatttaaacgggttatcaaacccgcaaagatccgaataaaaccggaaccaaagtttataaatacctgaatagagctagaatctttaaactcaaaatttcaaacccgaatagattttaaccgaattcgagtggatatgcaaatatgcatccctagcttagtcaatataaaacgatcaaatattacaaatatactatttagtataaataaataaaaactgaaaattaatacacgtgcggtcgcacgggtcaagatctagtttatgaattatgatactaactaatagattggtcaatgccctttatatattattttaaatctgattatatattttgaaataggttattaatacgttcttaagaattatggttttatactactttaacttgaactgaattccattctacaacacataataatatactatatttaaaccattcacagatcgtggtcaataaaaccatatataattgatcaactaatatattgtggtcagatctaactcgtataccctgttaaaaaaatgatcacatatgttttgatttcatgttaagtttcatccataaaccaatagtgggtaagcatgtgtgttgattatagatagtgtaagtttccttagtttacttaatttcgaatgtataacttccactcaaaagtatagtacaaagagaaagaacaacttagtttttcttttgacaaataaaatacaaatagagagaggtgtttggaacacaatattcaacctaaaggcaagtacccacttcttttgtttcttaaagattatattgaacatgaaccaagttaagatatctccaatgataacttcatttttttcttcgaaatttgaagtcattcaaaaaatgaagcaacaagtttttcaataatttgcttcattttcttcaaaaaaatatattctatatattctctatcactattttatatttaattattagtaacactttatacttttcaaatttactagttttactcatttattttgttttaacaataatccgactctaatagtaagttaaacattattatatgatataattattacacatgacataaataagtaaacatacacttttagattttataaagaaacaccaaatacaaatatcttaaatgattaatcagaatattataaaagccaaaattgagtttattttattctaatttcttctaaatcaaacatagaattcttaaaatttaataatatcatgtctttcgttattaacatctaattagatgaaagcaataatataaattttgaaattaaatgggtggcatttaaacatacaaaataacaataaattaaaattatagatcagtttgtaaacaaaaaaatatattctaaaaatgaacaattgaacattattttttcaattgaagaaatactgttcaattctcaaaattttaagaaataaagaaaaaaataaagtaccactacagtaaaaaataaagcaaaaatataaaatgaagtactattgaagatgatcttacacaacatatgatataaagttggcgagttagctaattcccaaagattaaagccaccgaaaaactacattccgactattttttttgttaccactcctttaaaataaaactacttttaaaaattcctcgtatatttatgtattttatgataatataaagtgtttgtttacctaagaatgtatctaattcacctctctatttacatgtataatagcatttagagataaaatattattaaacacattcttatttcttttacgaaattataaattgttatttttctttatttatggagaaagtaacatttctctatatttagcttttattttgaaattgataatttagagaaatatatctttttataaaaaaaaatctatgttataaaaagaaagtaaactatattggagaatggagatggtctaagtgtcataaagaaattctgagaccatcctttctttttttttttgatcaaaccagacttgcatttatcttaaaagagtttaaactccattagaggaggatacaacaaggctacaaggagccaaccaaagtgataaactgataacacaaaagataaaattgatacaaatcacaaaaagaaaccataaaaatcgcatgacaacgatttcataagcttctttaataatcgtaccaagtgtaacccaaacggtcacaaacactgcatcaacagcagaggggagcattagctgggaggaagatcctttgagtaccagcaacgctttatcttccatttcactccatacaagaggaaatattgggaagagaaacaactccaaacaggagacaattgggagaccaatacccgtcaagatcagattcaacaggcaagatatgtcaacgagttttccttccagctgcaacaaagaagagaaacacaagataacagcaccaaaaaccaggcttgacacaataaaggaactgcatactgcagtaagaaatcgcactgaaacgacatagatgccactaaaaggcacaaaggtagaaccgaaggaagctctgtccatcagaacattaccaattaaaaccaatgacctcaagttcaaagtcgcccatacaactcgcattccaacccattcaactgaataaaggtaagcggagagagaggagctatgatgaacctggaaggctgtaaccggagggtgggaaggaaggtcgggacaagatctgagaacagaccattccacgagccgacaaggaaacgacctgcacacaagagggacgccaccaccacagatctttgtcgccattgttgaacaatgaagctttaaatcaagggtgtgggtaagagcttgaagagaaggcttagtggaggtgacgcggatgcgaagaagagaaaggagagcgtctggagggtctggaggtaacggcggaggagcgacgggagagagaacttcaaccggaggatactcgtacggcagcgtatctgcaggaggtctgtaaaccaacggagcagcattcaccatcagggccatggaggaggagcagagctgcttcaaagggagtctgaaggagcgacggagctgaagcggtggagatccatccaaaacggcatacctcgggacgcgggcctgagagaaataattagggcgaactgagaaaagttagcagttctttgagaccatcctttctctctcgatcaattcaaccacaacaatagtaacttcaaaatacaaaatactatttaacttttctatttttaaatttttttatcaataaaaaacactatttaactatttttattattctacccgtatatggaaggttcaagataaatgttaatgggctttgttgtcttctcccttcccgaaactgaaccagtgtcatgtaaaaatcaccaactcataagtcaaaccctataattccgttctgcttttttccttgtctacaattgatggctaccgtagaaaacagaatgatgccggaaaatctaaagaagcacctcgctgtttcagttcgaaacattcaatggagttacggaatcttttggtctgtctctgcttctcaaccagggtacatctcctaatctttaccctttcctctgaagtttacagttttcttggctttctccacgatattgagacattgttgtttctaatcaagaactgacacaaaatatctgggcacatttcaactttcattctttctcatttcaaactttatctgtatgttgtgggttaaacataaaaaagactgttggagtggggagatggatactacaatggagacattaagactaggaagacggttcaagcatcggaagtcaaagctgaccagttgggtcttgagagaagtgagcagcttagagagctttacgaatctctctccctagcggagtcttcaacctcctgtggttctcaggtcaatagacgggcttccgcctcctctttgtctccggaagatctcaccgacactgagtggtattacttagtatgcatgtctttcgtcttcaacattggtgaagggtaaatctgtctttctcctaatcccatcatcaatcaaaccatttttttaaaaaaaacgacgtgaccctaacttttattatgtactctttattctaatttttgattaaaaaaattatgtactatatttctccttagaaaactgatagaaaatgtatactattacaaaatttcaaagatcaatgtatttttgtatagatatgaattaagattagtcaaacttacttataagagtactttgattttgtctaacaaaaaagacaaacatcctttattatcatgtctccttcagttctcatcttccacgatagcttattccgacatggacgagtttgattgttaaaaacgcaatgtttttacgtttgcgtgtttacaaagtatcaaccttaatatgagttataaatgatgatatatagacgcatttttgtcgtccggttaagcataaaacatctatactattaaagtacaagcacatttggatttttactcagtttacccctattaaagaagctttcttttgtattcattaatgatattttggacattctgtattggtttcttttttaattgtttttggtttgttattaaccaccggtttcctaattcaattttggtatgtgattattccgtgtttgatactgcatcattttaatatttttccaaccggacatgtttgaaactgcatcgttttttctcaaactatttaatggtttggttttaaactgctttttcctaaatataatcccaactatctaacaaaaattatttataaaaaataaaaattgtttattggttcaaccagtggttcaaccggtaaccggatttcgattttaatagtttttattggattttttaattttttttttttcaaacccgaactgaatttatctttgatcaaccggtaatccgttcaaccgcaggtctaagtcgaatttcaaaacaccgatcaaaactataaaactgttatattggtttatatttaaaatatctaattcaaaattaaaaacctaaaaatacatgtataatatagttttatcaaacataaatctggatataaaatacatatatgagacgaattatataaacacatatacaaaacgaattatataaatgtgattatataaaattttcacctaacataaacccgcgctttgaaagcgcggatcaaaatctagtaaaatgattaaaaaaccaaactaatttttccgtctttttattattgtagagttcccggaggagtgttggcgaacgggcaaccaatatggttatgtaacgctcataccgccgatagtaaagtcttcactcgctctcttcttgctaaagtaagtttttgggtagtttctatttgcaactggaaatgctaacgctataactaaaacgttttttcttgtggccgcttttgctcttttaagagtgcttcgcttttgacagtggtttgcttcccatttcttggaggagttcttgagatcggcacgaccgaacatgtaagccaatatttttatatttatcctataaactcagccgtttcgacgcataggagttcaaaccaatcaacatgcagatacatattatcctgttaattttttcgtttttttttgttcaaatatcctgttaattttttcatctatcaaaaattagcacaaaaggtaaaagtatttctagcaagtatattaaacaatataatttacattgatttgataaatagaaatagtacataaaaaagtcccatctgacaaaaggtttaaattctccgacatttctaatcaatattgtcataaagctgttatatttccagcgcttaatagtgaataatgaaagttaaaagggctaatttattattttttgttaaattattttaggttgcagagaacttaaacgtgatacaatgcgtgaagacattgttccttgaagctcctcatggaactttatcaacgagatccgattatcaagaaattttcgatcctttaagccacgataaatacattccagtgtttggaactgaagcttttccgacaacttccacaagcgtgtatgagcaagaaccagatgatcatgattcgttcatcaacggtggtggtgcatcccaggtacaaagctggcagtttgtgggtgaagaactcagtaattgcgttcaccaaccgcttaattctagcgattgcgtttcccagacttttgttggaacaaccgggagagttacttgcggtccaaggaagagtaggaatcaacggttagatcagattcaagaacagaataaccgagtaaatatggacgacgatgttcattaccaaggcgtgatctcgacgattttcaaaacaacgcatcagctagttcttggaccgcagtttcagaactttgataagcggtctagtttcacacggtggaggaggtcatcattgtctgcaaaaacgttgggagagaagtcgcaaaatatgttaaagaagattatatccgaggttcctcggatgcaccaaaagaaggcgttgttaccagacacaccagaagatagcgggtttaaggttggggatgaaaccgcgaaccacgccttgtccgagaggaaacgccgcgagaaattgaatgatcggttcataacgttgagatcaatgattccttcaattagtaaggtaacctaatccaacactttgcttcaatagcgttttgaatttacgacaagcgttttgaatttactacacgcgttttgcatgtgcatgctaaaatattacattatattttcaaggaaagtaatcttatatcttgtggattcttcagaccgataaggtgtcgattcttgatgatacgatcgagtatcttcaagaacttcaaagacgggttcaagaattggaatcttgcagagaatctgacggtaaagaaatgcgaatggctatgaaaaggaagaaaatggaggatgaagatgaaagagtatcggcgaattgtttgaaaagcaagaggaaggagagtgagagtgatgtgaatgttgaagaagatgaaccggctgataccggttatgctggtctaacagataatttaaggatcggttcgtttggcaatgaggtggttattgagcttaggtgtgcttggagagaagggatattgcttgagataatggatgtcattagtgatctcaatttggactctcactcggtacagtcttcaaccggggatgggttattgtgtttaactgtcaattgcaaggtacagctactaacacaagctaaatttctgttacctaaccggaatttgagtaaaccgaaactgatatatattttaatgctgattgcagcataaagggacaaaaatagccacaacaggagtgattcaaaatgcacttcaaagagttgcatggatatgttaaaggtctcacaatgttttagattgacagaattagcttttattccggtttaattttctaatctttggtactcagatatttaaaccggatttttttttgagattttgaaaatcttggcagatcctttgaaattctggtaaaatataatttcttttggttcataacgtagtcgtagactaatatgagttccttagttgatatataatgaaggtaaatcagatgatgcgaaatgaaacactcggcttagttagtacagtatctattcttgatgatagtacggtttgcaaaagaaaatagaagtaaaattagtagcaaatgcctatgttgtgactagttaaagattctaccaaacaaatcatatactaaaatctaaatagatagaagatagttcgatttcaatattcttttggtatatttaggaaagtaatgttttaaagtatagtttgaaaatataaagataagattggttggtcaaaagctgctaggaaagtgttttgttcacaaaatacaatgccttagtaaaaagaagtaatgtcatttcaaataattgcagctaacaccactgagaaatttgaacatgcgttacatattttaacaattactttatcataaaaagaaggaagaaaatcttagcacaaggagttggactgtatttggatttcgtatggtagcatccaaaataaagtctatcttttgagtaagaagatgttaactttactgcaaagaatacagaacgaggtgttagaaaattggtttgagacctttcttgatttagaacaagaataataaaggagaaattctttaatgagattggttgacatggtagatggtctctaacatgatccatcagttggtgaagttgacgcttcgtagatggttgtttagtaaaacacaatattaatttgttcgagaagattatggacctatgcatagaaccttttttttggttaaccaacaacatgtgttgatccaactagtgtctataaaggtggctatataccaactagtttgtatacatcaattaatatgtataaattcgactgtgacatgcataacgatccagctatagcatgcataagttaagactatatagcatgtgtctctaatgtacgatccagctatttgtgggacaccataataactataattcaaggctgatttctaaagctagaaagactatggacccgagtatctggaacatcctagctaactactatatgtagtagttctactacaacatatatgaccacattgtgcaaacctgcatatataatgaaaaaaatctgactacatcatgcataaatccagttataataacatacaaaatccaaccttcatttcagagccgttgcaattacagtaatcagtcatttgtgttacactttcgataacataaagagaaaactgatcttgagccaaagctggctgactcgagccaattgttagcatatgaaactagtattagacatggacatttggatccttgagtgggattttggtaggttctacttgaatccggatcttttgcgtcagatatttggatcaatatatttaagtacttgaactttttcggtttggggttcgggtaagtttcaaccgggtcaaaatcgttttgtgtcacaaaactaaatacatgtacagaaccttgagtgggattttggtaggttctacttgaatccggatcttttgcgtcagatatttggatcaatatatttaagtacttgaacttttttggtttggggttcgggtaagtttcaaccgggtcaaagtcgttttgtgtcacaaaactaaatacatgtacagagccggtaaatttatgttatatgttggattcgatcggttcagatatttaggacccgaaacatattcatagacttgaaaaatattaaaacctaaaagaatatccgcaaatatttaaatatctgaaaatacagtaattttatgtgaaacccgatccgaacacatgaaatttgagcaaaatatccaaaatatatttctaaaatttcaaaattatactcgaaaacccaaacccaaaagttgaaacaaaaaaattgtaatgccgaatgtatacccatgatacatgaaatgtttgatgtatacaattttttggatatttcggatatccgattgaatctcgagtagtgtcaagacccaaaatgagacctgcagatgaaaaaaatacccaacatgtattttattatatacctgaatctgaaccaaacataggttggaatgagtttgatttaggctggattgtacagtatgtgggtcaactggtcgacacggttcatgcaaactgatagagagcggaagctatgtaacttcaagatcaagggtttgatcgagaagccaataacgtatttttgaagataacttcaaaaacgggataagagggcgcgaatactcttcgcagtgttcgttaaaactctttagggttgcgaatactcttcgcagtgcttgtgaaagctcttaagaaaatcaatatctttattaattcaagtctgtcttacaaaagccatagtagagttctttatatagaactcttaaaccgtcatagaaattttaaacctaaatagaaaaggaaaaacataaaccttaagtaaaaaggaaataactagaaagaaggaaacttgtcgtttaagttatgatgctgctgcatcaggtcctcccggttgagaaggatttgcccacgaatctggatcatcattgtcgcctttgaacggagacaaatgcttgatgttgaagacgtcagacgtacgaaggtgtgaaggcaacctgacacgatacacattcggattgatgcgttccaccacttcgactggaccaagctttttagacttcaatttattgtaatcacgcaaggggagtcgttctttagttaagtacacccaaacgagatcacctggttcgaagatcagctcacaacgcttggtgtctgctgcaagtttgtatttagtcgtagccgattccaaatgagactgcgcgagcttatggacgtcttgaaggttggtaataaagtcaatggcctctccatgaaggcgagttttgtctggtgcagtcgaaagatccaacggaccacgaggaacaataccatacacaacacaaaaacggtgagaaacctgtactgcgattagtggcatgattgtgtgcaaactccgcctgtccaagcttagtgtcccacgactttatgttatctcccacaagacaacgaagtaaattacccaaagaacggtttacaacctccgtttgaccatcagtctgaggatggtaagccaagctcatgtcaagagaagtacctactaatttccataacgaacgccgaaagtgactgagaaaccgtgtgtctcgatcggagacaataaatgcgggagcgagagcgagagcgagggcaggagcaagggagggagcgggagcgagggagcgggagcgagggagcgagggagggagggaacgggagcgagggagcgagagagggagggaacgggagcgagggagcgagggcgaaagagcgagcgagggagcgagggcgagcgagggagagatcgagggagagagcgagcgagagagcgagatagcgagagcgagagagcgagagagcgacagagagagggcgggagagagaaagagggagagagagagagagggagagagggagcgggagcgggggagcgggagcgggggagcgggagcgggggagcgggagcggnnnnnnnnnnnnnnnnnnnnnnnnnnnnnnnnnnnnnnnnnnnnnnnnnnnnnnnnnnnngagcgagggaccgggagcgggagagagggagggagcaagggagggagcgagggagggagcgagagcgagggagggagcgagagcgagagagcgagagagagagagcgagggaacgagagagagagcgaaggagcgaaagagagagcgagggagcgagagagagagagggagacagagagagggagagagagagatcttataacaacctgatcaagagtaataatagctggagagagaccgccatgaacacaaaatatcttgttttcaacaacagctgaaagactattgaacacagaaaactaattatgaagattatattctcaaactgaaattattttatatacatagcaaaaaaaatgttgaatagtccatagagataccagattaatccatacacctaatctgcattgttcttagctcatgagatatctcaaccaccaacccttgcataatattttcaacgacatcagagactacaccttcagcttcaccaccacaatccaaccaaagacatgatggctttatcagatcagcctcaacgacctgatccaatgcttttggagagtcacagcagagtaaactccagtcaaaacgtctcaacgtctcatgtatcagatcttcttctctaaaggaagctggtacattgacgactctcgagctctgagacggcttgaaaggccaaaacttgatgtcttgacggtaaatctcgcggagaatttcgtctgtgtagtcaagaacaagaagaagctggtcgttgttgtgattaccgtgtgagaattcgtctagtagtgatgtttcttcgttgcatctcgccataagattggtccagttcagtcttgaagcttggagaagttgcttcacaaactcgtgaacagagtctttctcgacaagatcaaaagataacagtccaatctgctcttctgcgcatgaaaagtaaagagatagtgagacttaagtgattaaaagatgaaatcattgatcgatcagagataagagactaactgtttctgaggccaactgtttcatctaacatatgaatcctctctagtacagagacaggactcggttgctcttgttcctgtctttttatactcgactcctgcaacgatttagagaaagagattaaaacatcaaatccgttgcagagagacatctacggtttcttaaagaacgtacagctgatgagctctctagatatctatcttcctctagtccgtcttctacaggagctctcaggcttgttttctcactgagagaccttacattgtagctgtgcggatttggatcgaaaacctccaagtcctccttgtccaaggaccacaacttgaagctctctcttctcttctccagcctctctcttctctctttgagttttgtctgtaagctactcagtgctttaggaacttcataaaccggtgaagaatctgatctctcctgttgcctttccactgtgaacctccttggcgaaacatccttctcaatgcttagcttgaagacatcagactcaacacgtttcttgcgcctaaacactggtgactccgggcttctatagccaactgcactgctagaaacatcgccagaagcctcggtgtctttgttagatccaacaacaagcttcaacttcttggttagatgtttgaatctcaagtactttctgtcgtcaaccaagcttggtagtctaggcttcaagagaacgatctcatccaaatcatcagccagtgaaggagatttatcacgccgttccttcacatgaggtctctccaagtcttgaccttttttggctgagaacgagttaggatcttgtaagagtgtaatgaacaactctttgttcgagcttagaatatctaatgcttccatgaactgcttggaccggtcttttcctttctcctctgccttggaactgatcaatgtttcagcagcttcattcacacaaacttgaaggttaatctctgagctcttctttttacaatctctcccattcttcagatccatttgcttagccttctcaacttcactcaaagaagtttcctcctttgcattcttgatcctctttatctctctctctagtaaaccctgaacaggttttgattcatagctctcgtcttctctttcagaactaaaggatcttctcctcgttttaggcttacatgagttctctccttccacaatccgctgaacatatcaagagattcagttttctgcttccaaaaaaagccaactcaaaaaaactaaacaattttgtaaaaacttacatcatgacactgacatctctcatgaagtctcttgagcaaatcaagttggcttttagtataaacattacctgcaaacaaacaagaagcaaaattttaaaactaagatcatgaagtgatccaagaaacacacttaacagtactactaaccagcagagtctctgatgggtttcttctgtgaactcagtctcttattaccagatttaacatgtctgaaatcgaagaagttaatcagtttccaaccacaaccagacttgtaactctcgtagacaagagggcttttagggaaaattggagttccaggactcttgctgcttcttggtgatctccttttctccattgattatcaaataactcaaatcattcaaatatcatgtctacttcaatctagtaaaaaaaaaaacgattcccaataacctgaaacacacacagaaaccctgatcttttagacaaaatatgaaaaataccaacataaacaaaaaaaaaacagaggattcttgaagttgtgtccgaaaattacatcttcaggatacaaactgtcaattttactttctgggtttcatttttattccctactctaaaccctaaactgagatttcagtttcttcactaaaaaagccttcctttagtgtaataatgtaatatgtacatgtatatatgcgcttgtacagacttatctatcagagatttgcttaccactaagctttgaggttgaaatgggacagaaaaaaatgcaaactttttctttatacagtcagtggagccaatcaagcactgagctttgtcatggactgatgaactttttttaagagttaaaaaaaccgcaaattttgtttccacatacaaaagaaaaagggctaaaacatgattgaggttgaagatcttttgcgaaaattaaagggacccttgtctcttcctctacccttctaattaaaaaaaaggatatttttctgtattcaagaaaaattgtaaggacaataagtgaggattactgtttattcttggagatgggtcctctcaccattaaagaggcttttagtctcgtcctggagaaggagggagaggaggaggaagatgaagtaagactctttataaaataagatatatgattggaagagaaatgtaaataatcaaaagaccaattgaaaatagatctttattagaccatctgacatttttattttgttttctttttaacaggcaagcagacattttcttgacagtgggatttttatttatttctagtaaaaatttacaactacgtttttaattagcaaaataaataagcgaaaatgaagggcaggagagggacgtgagaatgaaagagactgtaattttgcagatcgtttcacatataagacaatgctttcaaataaagcttttatttctgtcatcttcttatctacaaatgcatgggggaataggatattcatgcatcaatttagctaaaattagataattagtatttgaactcagaaatcattcaaacctaataatttagctcgattatttctaaacttagatattcaaatttcaaaattatgatatatatcttgatgaagttaaataatgagttggatgctaaactaattacaacatcatgcaatatatataactgaggcaatagagatcttatatctgatgtgttagttgaactagcatgtcattcatcattgaactttgtcaacagagatattaaccttagtaaattttgaatatgtaattaaaaaaaattgaattgacgtgtatgtttgcacataatttagccttaagaattaattgttgtatttgaaataagttgagatatgaataaatcattctccctataaatgtgttttgtgtgtggacaagacttggattgaagacttggattcaccctctatggtaaacttttaaatttgccatctcactaataaccaatcaaagtgtcaactagattaataattaaaaaatattaaataactaaccaaaatagttagaaaaataaatagtgtcaattttaataatgctaatgtctctatccaatccataaactcaaactctaaaccctaaattctaaattataaatccaaattctatatcataaatccaaatattaaactctaaacccaaattttaaatcttaaacccaaaccataaatcataaacccaaacctataacctaaacccaaacctataccctaaacccaaaacataaatacaaaacccaaaccctatactctaaatatttggattaatattgatgttgttcttttgaaatttaaggttaagaattaaagtttgggttacggtctatagggtttgggttacggtctagggtttggatttagggtctacggtttgggtttagagtttatggtttgagtttagagtctaggatttgggtttagggtctagtgtttgagtttagggtatagttttgggtttagatttagattttttggtttataatttatggtttgggtttatggtttaaaatttgagtttagggtatagagtttgagtttataatttaaaatttagagtttggaatttggatttaggtcatagagtttgagtttaaggattaaattgtgatattagcattattaaatatgacattatttattttttaattaacaaatattaatttagttggcattttgattggtcattaggaaagtggtgaatttaaagattcaacatagggggtgaacccaatttttatcttttatgtgtgtgaatgtttgatgaaacatatacattacagagttgaaaaaaaagaaacatatacattacagattacagtaggtttatgtggttaaaacattgatttatcactgtgcgtaaaaggtctgtcacaaaagtgtaccttttctttttggctcaaacttttcctttctttttatcggaaatataaccgttagaatagaactcaagtaaatgaaataagtagtacatctgcttttaatgtttgttattattttagtcctaggcctcggcatttcggtatcggttcgattcagatatttcgaattttaggtagttcggatagaaggttagaggattcactgagtacttaacttcttttcgattcggtttagttcggatagtttggggttcggttcgatagtaaaactagaaaccaaaaagtacccgaaataattttggttctcatttggttccagttcggattcggatagctcggataaatattagttatttaggataaaatatcaaataattatgatgatttaaataaaatgttagaatattttggattattttggatatttcggataaaattatccggatacttttggttaatttggatatttcggacattttataataatgtagttatcttcaaatatttttgaattcttttaagaaattttttaattataaatatatatatatatacatttagttatgttatatgtatatataattaatatttttatatatttgggtatccgctcgattctcggttcggttccggttcggttatttcggatatagaaatatagacaccatacggatatttgaaggtcctcggttcggttcgggtccggatatttcggtgcggttcttcggttccggtttttttgtccaagcctagttagtccttcttgaacatttaccaattactagttccaagtacaaaaatgaatatagtttaattttcttcacacactaatcttgttaactagtaacgtaaagactcttatacttcccatctatgtcatattacgtgttgacacatgcacatttaatacgtgtgtatacatttatatatcaacaagttaatgtgtatatttcaatagtatatatttatagactggtgaacaaaataatataatctatagagcagccgatcccaatactgcatgttctttcttcttttcttttttcatattttgctatcgcgtctatccgtctatggttggttatcttacaagtatctttttagaaattattatatcaaactacgcttattcttcagatgataaacgaggaaataaaatacactggaatatattactaacacaatagtacaaaaaatgaccacgtacttgttttagtagttatattccaaatgccaatgcatgttcacgaagaatctggcaactttatttagtcctaatgagttatgtgcgtgaatgaataaatcattatgagatctacaattctacatgcgttttttgtatgatcaaatattatattatatgaaaaatagacaccaaatatttatacatataatttatataggtttcaattttttaactatgacttgttaattgttattgtcgtagttgagatggtgacaacgactgttttggacttttaattcaccattcacgaacttttgtaattatcgtttttgcatagaacaaagcattggtcttttcaaatgcgtgtattttactgctatcggagttgtatatcaataatgttttttatgaaaaatatatttaaataaaactatacatcattgaaaatgttattatttttctttactatcagtcagtttcttatttgcttatttattctgttatttcactagtgacaaattcaagtcttttgcaaacgtgtaagtttagcttaagtctttttttaagtctaagtcaattaagaattataacttatgtattatgttagtacaatctaatcgtattttataaaaatggtgtataccattaatatgattggttgactagtaacggtatacgcgtggttgtccacttatcttaagctactaaaaaaagttattaataatcaaattcatctaactttacaccaaagtttctctccgccgtccaatagaatattactatttatgccaagttgtcataatacatacatatgatatattacaatcgtttgtcaattgtcatacacgtaaattcagtagacgaactattttagatagtgtgccgacaaaggtatcacgacgtattacatcttctcatcatttactttatttttgtaatatcaaaacacgaaaaaatcgaccaatatttccaacttccccaaatatacaagcaagacaaatgcactttttagaataagaaactcatgcagtcatgtgaagcaaagttgaatgcagaatatgaagtttaccaagcaattaattaagatgttatcatacaataagttacatgttagacacaatataagctctaaattcttaaggaaactggagcactgtttatatatatatatatatatatatatatatatatatatatatatatatatatatatacagtattgcctaattaatgagagtttctcattctataaactaatacagtagaacctctataaattaataatctataaattaataatctctataaattaataaattttagcggttccaagttgggccggtgttaaatataacacaaatcgataaaataataagataataatatttttaaaatttctatgtaaatatatagtctccttaaaatcataaattaataatttatctatatataattttatataagttaaatattatattgttggttttatattcacaatgaaaattctttacttttcttaacatttcaatatattttgataacatttagtaaaattataccaaaaacaacttaacaattctatgaaacataaaattatacataaaataagataataaaacaatattgaagtcaagtttataaaatttaaataatgtacatacggtaaaataaaatattttcttttttatataaataaaaatagaaaaatagaaaaaatctaaataaagaaacttttgtaaattaatatctctataaattaataaaatttcaaagtcccaacattattatttatagaggttttactgtataatgttatattacgatataatatgtcaagattaccaatcttgacatattatatagtaatatgttaattaatcaaactacattgcttataaaaacaccaacgtattaaccatatcttgtaacacgtattatctaaagactgtgacatggttgagttttagttttattaatattgtgaatggcagtcgcatgtagtaatgtacacgatacccacgttaattaagtcatttcttggtattttatgatacattaagaaaacagtagttatattacttatgtacatttagcatgtgtacctcacgtgttatgaaatgagccgggtaaatgaagaaacgaggctcaagtggaaaagggaccacaaagggtgttatgtattaaaccaactcaactgtaaatggcggtggtcgtttcaaattaaagtggccatgtgattttattttgttccgtcagtgaccaagatactggacctggttaacataagaagaatcaaatagaactctttcaatatactagaacttaaaaagaaatacaaactagacttcattgcaatgttgatttgtggctggtgcttgttctgtttagtttgaacatctacagctaatagaaaggtgtctatcattgctcaaagtgttacaaaaaagttttggatgcagttatatatatgtagctaccggtgaccattttagctgctgccttctttgaccatgagagggggatattgaagggaaccgacccattttttcgtaccatcagtacaagtctggttcgacttcctcgattagatttaggccgttttccaatttttctatattttaaattatttccgagttttagttcattctcacacaagtcaaacaaccataatacgatttgaatagataatcagagattcgagctaataagcgagtttgttataagctattacatgttaaacccgttctctatctacccaaatccaccatcttttcttcttgccttaatcccgcgattcaattatgtctttacctttcttgcatttgtaactaaatcttttatttaagtttgtaaacttttattaaaaattaagattgaaatcaaacctttatttttgttatatatttgagatccatatattgtactgttttataatcacatatataattcttcaataataatataattataagtaccaatttgattttaataaaatttaaattagtaataaagtttcaacaaccaaattttctaaatcgataattctacagccaaaacataaagtgaaaaatcttacctgtcaaacccaaattaaaacaatagtcaaagtcttgtcttaaacaatcagagcctaaatcatttgtaatcttactctattttttattattttataatatagtaaaaattagattactataatgaaatactatttattttttactcattactctagtttttttactttaaaacaaaataaagttatagtaaaattctaacacctttataatttgtaaaaccaaaataatattttacacaagaggtgctctggtacgaaggtcttttcagagtgttggatagtttttctgcttgtgctcaagcgtctgtgcagcaacatggtctgttctgcgtccttcgggatatgcctctctacttgggcatgtcgttttatcctacccaatggtttcatttggtcggtgtctatgtttggttctagtgctctacttatatttttgagatccttacatcgggtgtaatattcgagtaaggttagttcatgcatgcaaacccaatcgtggactagagcagtggattagtcggatcagtgttctcgtggcttcggtaaattgtgaacaatatattaagaaactttatgatccctaatctcttgttttagtaatgttaagtggctgaagtgaagtctttcaactgacatcatttgttgctaattcatcctagttagtagtttgttgccgtatctttctggtctcgttgtttagatagtccgtagtaatcgcgtatagttcttttgttcaggtttttgtctcttgaatgttctttccgccaactttctggctttgtctttctaactttgccgattttctattgtaactcatgttttatttcttcaataaacaaccaaagttgtagtagtccagtgataatttttttggagctcagcgtgtatccatatttgttctgagtttgatacttgttggaaactaagtatcactgcttagccagccagtgtttgggtttcgaccaaagtatcactgtttagccagtgagtgtttgggtttcgaccaaaatgatttacaattggtctatccctaacaataaggaatgggcacaaaccaaatacttgctgattttcaaatgcttgatacttggcttggttcgttcaaataatcatattcacgatttggaatttacttgtttaaaacaaagtacttactatatcaagtacttaagagaaaaatagtacttgcaagttacttgatccgatttattgttaaaatcaagtacttgttttaaaactatttattacttcaaaactgtaagtaaccaaaaaaaaatcttatactccctctgtttttcaatatatgatgtttttattgaatgcacaaagattaagaaatttacattcttgtaaaaagaattttaaaatatatgattttaaaatcattcaatcaattataaaatttttattggttgaacagttttcaataaaataaaattttaccttaaaacctcaaaatattatatattttgaaacaacataacacttctaaaacatcatataatttgaaacggagggagtaaaaaataactagacgaattttgctatctttttttaatcaaaaaacttattttatcaaatctaatatgtttatctgatttttgttacaataaaagacaatatatttttaatagataattaaaaattctagaaacaagtagcgaataatatgtaaacaataagtatataacaagttatacggcttattatccgatttaacaatgtcaaatacttgatttttaaagcgaaacaagacaaacaagccaagtaaaaagaatcatggctcacatagtttttaaatttaagtggattaaggttttgaaactgtaaaaacttatgccaatgttgattaaacaaaaagatatatttaggaacgagtaacaaatccaaacaagtcgattaactttttttttaaagacttgaaatttggtttgtatttgcaagttttttatttgaagtatttgttacttgaccatcactgcgaatacttgattttacggagaaagtacaagacgagttgcgagtaaaaggcgaatttccagtatttgtgcctagttatacttaacatcagttggaaagtactccaaacctaactaaacagcgtagtgacagcttcgcactaaatccattttttacaataagtacattccgactagaataggaatcgaccggatagtgaaaatgaaaaaaaaaaagaaaagaaatctccaataaattcctaagatgacaagatacaggaatcaaatcaacctattatctgttaccattttaagtgggctattttggtgggcttggtcattattacgccaaacccacctcgtatcactaacactcgaaacgcaccgtattgtcgtttggcaacaaaaaaaaactcttatccccttcgaaaaacctttcttcatcacactccctctcctgtctctccaatggccttcactttcttctctcctcaccccgtcttcctctctctaggtcgaaccacctcttccttctcctcctacaaaccggcatactcaccattctcccgaaatccccgtaataatcttcagttagcggcgggccccacccgtcgtagctcttacccgaacccggcggatgacgacccgcccgaagccccggaggattcgatgcacggcgtctccaagtttcagcagatacagcgccaagccgctcgagcgcggaagctggaggaagaagacttcgagaagaaccgaaacacgtacctctcggccatcgctgacgtggaagacgcgcccgagacgggacgcgatgacgtggagtctggaggcgatctgttctcggacatcgatagagccatctcaatgaaacgtagcgagttcgttaaaaaaggactgctccaacctaaccctcccaaaacggcgtcgtctaagaagatcgacgaggaagaagaagaagacgacgctgttgatgagcttgacgaagaagaagctgtggatttagacgagatcgataaactgactggattaaccgaagcttccgacgaagaagactgggtcgacgaggaagggaaccctaggatcatcagcaagaagaaggagcatcaattcgagttcgatttggatgatttcggcgaatccaaggcgagaatcgtggagcctaagttcagactgagcttagccgagctcttggacgagagcaaagtggtgccgatctcagtctacggcgacttagacgtcgagatcaccggaatccagcacgattcgcgaggcgtaagcgccggagatctcttcgtgtgctgcgacggaggagacgactccgtcctgagcgaagctgacaagagaggagcggtggcggttgtggctagcaaagagatcgatattgaagatacgttaggctgtagagcgctcgtcatcgtcgaagacaccgaagcagtcttggctgcgttagcttcttcgttttataggcatccgtcgaaggacatggcggttatcggagtcacggggactaacgggaagacgaccaccacgtatttgattaaaagcctctatgaagctatgggtgtgagaacaggaatgttcagcagtgtttcttgttacgtccatggagataacaagatggattcaacgacgacgagtcctgatgctgttttggttcagagtatgatggcgaagatgttgcataatggaaccgaagctctggttatggaagcttctcctcaagaactcgcttcagggaaatgcgacgaagttgatttcgacattgcggtcttcacgaatttagccagagaggatagtggctttcgcggtactgatgaggagtatagagatgctgaagccaagttgtttgcaagaatggtcgacccggaaagacacaggaaagtggttaacattgacgatccaaacgcagcgtttttcgtccagcaagggaaccctgatgttcctgttgtgacgtttgcaatggagaacacgaaagcggatgttcacccgttgaagtttgagctgtctttgtttgagacacaggttttgctcaatacacctcagggtatactggaaatttcgtctggtttgttaggacggcataacatttataacattcttgctgctgttgctgtcgggatagctgtcggagctcctcttgaggatattgttagaggtgttgaggaagtcgatgctgtcccggggaggtgtgagttgattgatgaggaacaagcttttggtgttattgtggatcatgctaacacacctgatggtttgtcaaggctgcttgattcggttcgagagcttaagccaagaagaatcattactggtatatacatcttacgtctatttaatccatatccactagttcttatggtgtttatatgtattgtcgtctgatttgttaaagttattggctgtgcgggtgagactgagagagggaaacgaccggttatgacgaaaatcgcaactgaaaagagtgatgtgacgatgttgacatctgataatccggggaatgaagatccatgtgagtaaatctgagattagctcgagtctataacccttgatgtgtaacaggtagaaaactctttaaatgtgatttcagtggacatattggatgacatgttggctgggattggatggacgatgcaagagtatctgaaacacggagaacatgattactatcctccattggcaaatggtcatagactcttccttcacgacattagacgtgtagctgtgcgttgtgctgttgcgatgggtgaagaaggtgacatggttgtaagtatttaaataaacccattctctgtacaccttttttactttccctggtgtgttattaaggttgctggattgaaattctttaaagtaatctcagcttctaagttacattatgcaatggtgtttcttgacactgatttactttctttgcaggtggtagcagggaaaggccacgaagcgtatcagcttgaaggtgataagaaagagttctatgatgatcgagaggaatgtcgggaagcattacaatacgttgatgagcttcatcaagctggaatagacacaagcgagttcccatggaggtaagtagaagagaaacagcctcttttgccaaatgattaaacagagattctgatctgtgagagttactgaaacatgtcaagatgcttcctctgatcacactaaatgttctttcctcgtattgctctgcttttgcaggttaccagagagtcattaatatctctctatggtgagatcattaaaccatgaatcagatttacttccaccgccaagatagatttgcagagagctcatgaattctgtacgagagacttggaggtgtttaacaaccctttgtgagtcatcaggtaagtgtaggggagagaagagattctaaaggtggaggaagatgtgtacaaatttttgttagtggttgttgcgtttgtctgtgttgagggtttaagatatggcaggtgttttttttaataataagccttcattggctcgaaattaaattggatgagaacataaaacaaaatcaacacaaatgagtaggacataccacacactgcaatgagaaggaataaggcaactccatactaattagcaagacctaaccaaaagaaaaccctatggcgaatatggaaggatggtggttgttgtttcaaggtagaggactaaggagttgcagaaggaggttctgattgcaagagggaagatggagctacgaaaagaagcaaggtcatagccgaacggagttggatgtgaattcagtgttaaccgaaattggatgtggaatcattgttaaccggagttcgagctggagagagtgcagctttcttttttttaaccacgagctggagagagtgcagctttctctgctcgttttcttctttgctttttctgtttttaaaaatttgatgaaatcacagaacaagtgataaaaaaaaatctatgaaactgttgttaattgtagcaataagaatcaatagagaagcgtagctacaataatcataaccgatggaattcacctacaaaataaaatcaacaaggccttgtaaatttggaaaagaaaagtgtctttcattctttcattcatcctccaactgataccctgcaaaacaaacacaccaaaccattcatttaagaaagtttccctgatgctacagcataagctgcagctcttctccaaaattataaaggtaagcaaagaaatttgaaaacaaaatgtgttgaatgacatacccacactcatctgcagatcctcaagcattgccactgccctttctagttcctctttactccaaaaaccagtcagcatattgcggatagtaatggtatcaggatacacaccacttgaaatcatctcctggaaaatgtctagagccccattaatattacccactttacgaaaaccataaatcaaagtgatgtaaataattgcatcagcaactatccctcttcgacccatctcgcagaaaagctccagcccatcatcaacccttcctgccttacagtagccattaatgagtgtgttaaatgtcactacgttgggagagaagctcttgctacccatcgaaacaaacatttgtgtagcctcatctaggcggctctgcttgcatagtccatcgatcattgagctataggtgatagtatctgggactatacctctgtgtggcatctcctcgtataattcctcggcctctaaaaacttcccttcattgatcaagccgcagatcaatatattgtaagttagaacatcaggttccacaccattgaaggggtgactagcatcaagatccatcttactcttctgcatagccttaaacatttccaatgcatcttttagtttcccattatcgcagagaccgtccagcaaagtgttacaagtaacgatatcagggcacacaccactagaaatcatctgctgtgaaaggtctagagcagcattaagatcgcccaccagacagaacccgtgaataagagtgttgtaagtaactgtgttagcaactaatcctcttctaggcatctcatggagaagttccattccatcatctatcctcttagccccacaatatccgtctatgagagtagtgaaagtgaatacgtccggagagcagcccttggtagccatcaaataaaacatgtcctcagcagcatcaagacgatcctgtttgcaaaacccatcgatcattgaattatatgtgattgtattaggaatgataccccttggaagcatctcatcgtataattctgcagcctcgaagaacttgccttccttgacaaatgcattgatcaaagcattataagttacaacattagggctgatcttcctttctaacatttcttgcaacaaccgctgggctgcactccatctaccagagatgcaaaatccaccgatcatacagttgtaggtaactatatttggaaagattcccttgtcttgcatttcaatgaaaagattatgagaatcgctatggcgtccatctttacaaaggccatcaatgatggcactatagataaccacattgggtttgatgtggcttatctcctccatcttcctcagaagattcaatgcagacacagtgtcgcccatcttacacatcccatctacaaatgttccgtaagtaatctggtcaggctggagaccattttccaccatccgatcaagcagagctacggcttcgacaactcgaccctcgcggcaaagaccattcatcagcgtggtgaacgttaggacatctggtctacaaatttgatgaaacaaatccaaggcttcagaaaccctgtgatcaagacataatccgtggagcagggtggtgaaggtaacaacatcagggtggagtccaagcttggtgagcttaccaaatgtagacaaagcaaaggggagcttagagcaactgcagaaacattttatcagaatggtgaagctgtatatatcacatcgaatctgtttcctttccatcttttgatagagagaaatcacaagatccgggcgttccattctcaccaccgcacccattagcttgttgaaatcaatcacagaaggtaaaggacgagatcgaagcatgtcactgaacaaatcaatcgcatcctctaaccctttgatttcataagatccacttcgcagtttcaaactctctcctctaaaacctgcttcgccactctctccatccctgcttttctcggccagagcatgacgaatcgatcccgtacagaaaaatctagccgcagacacagaagacgaagaggaagactcgaatctgcaaaccctagccaacatttcgcctgagattaccaagaagccaacgacgagtgagtgaggagtggtcaagtcgtgaactttttggcttgagcgactataaccaaatcactgatttgaaatcagaaaacaatgaccgtgtcaattcggttggttaaataatcggttcaaattgattttacactgaccggttcaactcctgttgccaaaacggtttaatcaaagttggttcacttgggatgaaccgggaaaagtgcctattccaacctgaacaatttggatcgtgccaaatacaacccgaactaatggttagtgccaaatacgacctgaactcaattaaaactttaaaaacctacccgaactttttaaaacgtgcataaatctacattgaaatattattaaaaagttgaaattacataaattattattttttcatcgtattaaattttaaaactttggtgataattttttctgatttatataaatacataacatgtttttacttattatatcttcaataaacttgtatattactaaaatataaataataaaatatttataattaaattatcttagatatacttaaaattttaaagttatttataaataaaaaatgtatagattatttttattttttaaacttaagtgaattttttttcaaatttattattagatattttaatattttgttcaaaatttttgaagttatttatattttgaaccttttacctttcaaaattgaacaaaatattaaaatatataataataacttttgaaaaaaatcacttaagttttaaaaataaaaataatctatacaagaaatttttataaataacttcaaaattttaagtatatttgagatcatgtaattataaatattttattatttatattttagtaagatataagtttattgaagatataataagtaaaaacatgttatatatttatataaattagaaaaaattatcaccaaagttttaaaatttaatacgatgaaaaaatagtagtttatgtaatttcaactttttaataatatttcaatgtagatttatgcacattttaaaaagttcgggtaggtttttaaagtgttaattgagttcaggtcgtatttggcactaaccattagttcgggttgtatttggcacgatccaaattgttcaggttggaataaacacttttcccgggatgaaccttggccagaatcaacctcgtacccggtcttactcaactcttttaggtaactaaccatttctagaatcagaataaaattggataaaaacctaattattcatcagggaattacacaagataaaaatggataattagttctttactttgtaactaaattttaacccgccctttgatggcgggtaatttttgttttaatttttttttgagatttttgttttatgtttttgtaattatatttgtaattattaatttagtttgatataattttggtgactatattaaatatgtcaagtacgtaactatatacttgtactatatgcatttcaaagattattttaaactttatttctaaagtttacaacatattatattttttagtagctactaaatataattagtcaaaaatattcgtataaaaaaaatctgacttggaatcgatccgaaaattaaagttttatattcagtgttttgaaacccgacccagatccaagattgaaccggtaaatccggtgatccaagataaatcagatttaggttttataaaaaataatattttaaaagtcaaaaatcactaaaacttggaacccgattagtgactaatagataacttctactttttattttagtttttaattatgtttttaaaatctgttttgtataacttttagtaaataaattaggttttttaatttttctatcgaccatttattaataatattttaattttattagaaatagaatatattttgtataatgtattgttggtatattttgaggtttttctattttgtgggtgcattggttttacgatttataaattatatatgcatattctttcatttggttgatgtaatcgtagatggagtagatttttttttttccgtcaagattttatattaaataaaggccagagcccaaaagcttacaaccaaacgagcccgctaacttcgggcccaaattacaatccgaaacgggcctacagcccaaacaaaccaaaaccctagcgctacggaatgctcgggatgtcagccgccgcgtagatctaaccttgggagaatcaagatacgtgttcacatcctcgtcctcgagagacacgcgtcacgcaggccagcacaccaccaccgcttcacgctaccaccggggaaccacacctcagttcaccggaacccaaccggagctcacaaactccacacatcctcatcgcgaacactttttcgatctaggatggctctaatcggagagagcatcaatcgtcgctacgagatctcatcccccgtagtttatcgcacacaccctagagaacgcttcacatgcatcaccaaccttcccgccggagaccttcaccctcctccgacgagaccacggtcaaccaaacccaaacgaaccacaaagagaagaaaagaaaaaaaaaaaaacctaaaccctaataaactaggagccgaaagccggcggcgcaagacagtggagatcatcacaccccggagactagaaccgatgacggtggaaccgaagaggcttccccgtcgcggatacgaaggccggcgtcgatggagctaaggtagcctccatctcccagaagtagacccaaacaaaagatgtcttcaccgcgccatcaacccaccaccgcgtcgttgctccaagaacagaaccaccgctgaggtggctggccagagttcggacaaagcagatgccggaggagatagagaggaaaaacatcagactaaattttagcttaaagaaaacagacaccgacggcggcacggacgctaacgcaccgaccgaccgccgggtccaaaccacgattcactttttctctcttttctttctcttctctctccaaaccacgattcacttttttgtgccttgttctagatggagtagattaagttgttgtatttttaatgtaggttctgactaatattagttgaattagttagtatataattaggggaaataaatataattataggaagcacaaaaagtaatatgccaaggaaaatcaaaggtaaatctataaaaggtattctgatttaattatattgatagtataagaatcgatactaaataccggtttacaagcaacaatacgcttttagttcgtttctttggcaagaacagaatcaaagcgttgtgagaacaatcagcaacttttgatgatggctatactgcagcttttccaacacttttggttccataaatatgtctcatatgaacttgaagttaagtgctttctcaagaaacacgcttcttcagtgcctccccaataatcacagtccacagatcagatcagggtctgcaacccatgtttaatattgttggacatcagggcataagcttccttgtcacaacctgaaaacacactcgaatcaatgatttgaaatagccaaattaaatagagaacgttaaggattataaccaatggagttaagaacttaagatcactactgatgatttagacaaaagaaaggacagaccctggatttcaaataaaccgaacagagcttcagtaacgccatatgcaaccaatagagaaacaacacaccaattttctgtcattttcctttttcagatataactaaaactagacacatagaaagttttaagatgtccactctagtagccgtgtgaaaatactagtaagcttaaggtataataagtatgagagcttttcaccactctaacaagttatatcgctgttctgattgtgataaagttattgctacccccaacaaaaaaaccgagacgttcttactcaaataatggctgtattatcttctttttgcaatttcactcttaactctccctgctaccatgaaaccgcatggatctgcattgtcaatctaaacaccatgacgacctcaaaatcacagccacgcaaaaacaaagacgggttcacaaattacaaaccaactgattctagtaacgagaaatgaaggacagcacaatggagtttcaaatgcttgcagcaatcatattaatctcaatgcactttggattgtcacatgttgggcatctcagttacccatctacacgttgatcaacaagagcagtttttctgtttgctaagaaatcaacgagagcagtttagtcccagctctaatacaataatcccaatacgttaacgtgttcattatccactaaaaactgaaattcataaaatacacaattgtatatatcatccgggatgattcatccccaaaactccgactctaatactaaaacaggataagcaagaccacctaatctaaatattaagaaggaaaaacaaatcagaatctagaatcgcagggaaataacacagaccctatttgcctattctcatagcttcatcataagcatcatatacatatatattcaaatgcgatgattacacaggttgtcacaagaaaagcattgaagtattgttctcacttactttaactcagttttcgtcaccttacacaatgcaatgttgactctttctttgatccaaccactgggagtaatctcttaaaaaagttagaccaagcactgaaaacaattagaatataacatttgcatctcctcacccagagagatgacaacacaaatacttcttcatcttggacattgtgtgatgtttgagagagagatgcaaaacggtggggttccggtttataagtcggagccaaaccgttttagtatcgatttttagttcatatgatcaatctctactctctaaccggttttactatcaagaaagaaaaaagagaagcttatagagtttgtatttctcgtctctggtttctttgttgattaacaaaagcttaagcaataatagaatgaatctgcaagtttattctacgtatggtaaattgatttcatagcaatttggagataaagaatgaagctaagcaagtcaagaggcgaaccagagaagcataagcgacaacaacatttccaccaagattaaaagaacatgatctcctcctgaacccacatgggagcagacaaggcaggacagagccaatatgaagaagaggaggaagatggcatcacagctatcagctctcatgaagaccgagcttgacgataaccatggtgacagctacagaacgggcagacacctaaacatcttttaacacctgaaatcttctggaaggtgtgcctctttagttcagaccaataatcttgcgtgaaacaagtgtatggaatttaattggaaatggtcaaatttattaagcccagacaatagacgcataaaaggctgtcattagaatagcagcaaaataacttactaaccacacaatttttcactatgatcactctattcaacgatttgatcaaacattagtagggtatacatgcagcagcagaaacaaaatgacattgaagctctgctgcgcaaacagaagaaaatctttgatcattcatcccccaaatgatagatcctacaatgcaaaaccaaaccaatggttaattccagaacgtgtatcatcaatctgaagctacacacaaaagaatgtatacattcttgtttatataaaaaatacatagactgaacagaaacttacataccatactcatctgcagtttctcaagcattgccactgccctttttagttcctctttactccataaaccagtcagcatattgcggatggtaatggtatcaggatacacaccacttgaaatcatctcctggaaaatgtctagagccccattaatattacccactttacgaaaaccacaaatcaaagtgatgtaagtaattgcgttagcaactatccctcttcgacccatctcgcagaaaagctccagcccatcatcaacccttcctgccttacagtagccattaatgagtgtagtaaaggtcactacgtttggagagaagctcttgctacccatcgaatcaaacatttgtgtagcctcatctaggcggctctgcttgcataatccatcgatcattgagctataggtgatagtatctgggactatacccctgtggggcatctcctcgtataattcctcggcctctaaaaacttcccttcattgatcaagccgctgatcaatatattgtaagtttgaacatcaggttccacaccattgaaggggtgactagcatcaagatccttcttactcttctgcataaccttaaacatttccaatgcatcttttagtttcccattatcgcagagaccatccagcaaagtgtcacaagtaacgatatcagggcacaaaccactagagatcatctcttgtaaaaggtctagagcagcattaagatcgcccaccagatagaacccgtgaataagagtgttgtaagtagttgtgtcagcaactaatcctgtttcagtcatctcatggagaagttccattccatcatctatcctcttagccccacaatatccgtctatgagagtattgaaagtgattaggttgggagagcagcccttggtagccatcaaataaaacatgtgctcagcagcatcaagacgattctgtttgcaaaatccatcgatcattgaactatatgtgattgtattagggattataccccttggaagcatctcatcgtataattcttcagcctcaaagaacttgccttccttgacaaatgcattgatcaaagcattataagttacaacatcagggctgatcttcctttctaacatttcttgcaacaactgctccgcgtcgctccatctaccagagctacaaaaaccaactatcatactgttgtaggtaaataaatcgggaaagattcctttctcttgcatttcagtgaaaagattttgtgcatcgctatgacgtccgtctttacaaaggctatcaatgattgcactatagattacaacattgggtatgatgtggctcacctcctccatcttcctcagcagattcagtgcagacacagtatctcccttcttacacatcccatctacgattgttccataagtaatctgggtaggctggagaccatcttccatcatccgatcaagcagagctacggcttcgacaattctaccctcgcggcaaagaccgttcatcaaagtggtgaaggttacgacattgggcctacatgtcgtttcaaacatttgatgaaaaaaatccaaggcttcagaaaccctatcttccacacataatccatggagcagggtggtgaaggtaacaacatcagggtggagtccaagcttggtgatcttaccaaatgtagacaaagcaaaggggagcttagagcagctgcagaaacattttatcagaatattgaagctgtatatatcacatcgaatctgtttcctttccatcttctgatagagagaaatcacaagatccgggcgttccattctcaccaccacacccatcaatttacagaaatcaaccacagaaggtaaaggacgagatcgaagcatgtcactgaacaaatcaatcgcatcctctaaacctttgatttcatgaaacccactttgcagcttcaaactctctcctccaaaacctgcttcgcaactctctccgcttgccttggccagagtatcacgaatcgatctcgtacagaacaatctagccgcagactcagcaggagaagaagaacacttgaatccacaaaccctagccaacattttatttttgtttcgcctaaattttgttcttcgtcgatctctaaaaaaaactcgtgactgagaaaataaacgagagataaagtacaaacgggttccatttgttttacaagaaccggttcagtttgaattatacaatttccggttcagatttgtcaccagttgattgattgagttccttgtttaaacccacagggccacatgattcactaaacccagagccgagagaaattgataaaccgagctattgaaaccagtagagttccggttcagtatttattactaagccttcttgtttagtccacttttaaaaatcaagacgaccaatcaaagaccatttacagactatccacttctaaaattattaaacgatcataaaaatttatcaacagccaggtgtgttaaataattatattagaggaaccagttaatgacatttttattgaaccagttaatgacatttttattgatgttataagctaacttaaaatataaacaaagtttatttactttgggagaaccttggccatcaatatcatcccctatttcattcaactcttaagtaactaaacatttgactcaaaactaaattggatatgtacataaacaatgagttggacataccacactgcaatgagaaggaatcgagaatctccatactaattagaaagacctaaccaaaatctaacctattaatttagggttctattttttatctactgttcagagtagggctggacaaaaaaactgaatccaaagaaccgaaccgaatccgatctgcaaaagtaataccaaatccgaaccgaaattaattgaatatccgaataggtttaaatttttggtatttaaagaaccaaaaccgaacccgatccgaaccaaaatattttggatatccgaatgtatccgaaatagattaatatacatatatatttaactatttttagattgaatatatattaaaaagcatctaaaatatatataatacttttaaattgttcaaaatactagaaaatatataaaaacattaaaaagtacatgtataaatagttaaagcatactcaaaacaccaaaaatatataaaatatgattgattttctatccaaatatccaaatcaaaccaatttacatgttaagttttggtacttcgacacatattattgaaatttatatgtaatatattattttgtttacaaatttcgaaaagtttaaaatatataatgaaattttaaaattttgaaaataatttaaacgggttatccgaacccgaaccgaatccgcaaggatccgaaccgaacccgaaccgtaatttagaaataaccgaatggggctaaaatctttgaccccaaaaatccgaaatccgaatagactcgaaccgaaacccgaataggtacccgaacgcccacccctagttcaaagattaggaccacttagttaaatatttaatatgacatatatgtttatttatattaaatcttaataatcaaaaaaaaaaaaaatcaattttaacaatacatttgaattttattttagctataacaaaatttgttgaaaaaaatctaacaaaatcctacccaacgttttaaatatttattataaaataatgtattaattaatttttgcaattagtaatataataatattataattattgttatttagaattttatcataaaacaatgaaaataaaaaattatgctattttataaatttatcattataatctatgttgtactcaaatagaggtgttctaaactaaatataaaagatgtcaaaaaaaaatgaactaaatataaaataatatattaaattggttgattaaatctatttttaaaatacttttatgtaaataaatttatcactcacggttaaaacattgtaagagcagctctgctcgttttcttttttgcttcttctgttctcaaaaacttgatgaaatcacagaaactgagtcaagtatatgatcaggaacacagaacaagtgataaacaaaatctatgaatatgttgttagtgataggagataaaacactacttgattccatggaaaacgtcaccaacggcgcaataagaatcaatagagaagcgtagctattctgtaatcataaccgatggaatgcacctacaaaataaaattatctagggattgtaatttggaaaagaaaaatgtctttcattcttttatgggtcaattaggggaaagggcaacttttaagtttgaattaggaaaataggccacctcaaatttatattaggcaattgggcaacctagtagagagagaataaatttatgacatttttaacctttttgcctattaaacttggcaagttggaaaagtaatttcgtgggacccaaaatccactttgcctataaaaaataatttttttcccactaacttttaacaactaacttttgtaaatcccataaacattctttattcattaaacttttggatcatatttaatatttaaaaatcatatatgagcaactacttttaatataatacatattttttcatatataaagtcaacataaatctatacgaattaatataaaatcgatgtaaattctaaaatttatgaaagttacccaataaattatacattttgactcataaaagaaactttcatatttatgaaatctacccaaataaatgataattcataaaattatgtaaatttatggataattatcataaatctgagtaaatttaataaacttggaaaccttcatagatccttcattttttgccaaaatggcaggaaaacaaatttgtctacatttaattttaatatagttgggtaaatttaataaatttggaaacctacgtgaatcttacatttttttttggtcaaaattgatctcacactttttgtttttgccaaaaatagaaacactcacgaaatgctacatttttttcccaaaaataaaatgacaaattgggatctggcagcaaagtgcattcgttataattttcatgtttataaaatgacaaaaattgttaatgaaatgacaaatttgttaataaaatgacaaaccctacacctttcacgatgaactgatctaataactttaattttcaaggatcatatctacttgttagaaccaatataatcccatattgagtacaacctgcagatttccaatcatcccaagttcttgactagtcataggtagagccgtgcttataatctattgaaaaagatatccgctatagtgctatttcaccccaaaaaatagagttatccttaggttcacccctagagtgaacatttaggttcacccaaccaataggaatcaagtatttcataattaatattttttttaaaaagaaaagaaaatattgtcaagttatattatgtttttaaaataaataaaatataaaaaaaaaataatagccgttacaaaaaatgaatttttgaaaactatttttaatatcgtcaaaaaacactaaaccttaaaccctaaatcctaaaccctaaacccttgggtataccctaaacccttggataattttaaactctaaaccctaaaccctaaattctaaaccctaaaccctaaatcctaaaccctaaacccttgggtataccatagacccttggataattttaaactctaaaccctaaaccctaaattctaaaccctaaacccttggataaatcataaacacttggataatcctaaattctaaatcaaaaacactaaacactaaaacattaaatcttaaaaatactattatggtttaatgtttttaatttagggtttagtatttatccaagggtttaggatttagagtttagagtttagtgttttgttgacgaaattaaaatctttttaaaaaatctttttttttgcatatattattatttttattttttaatatttttattttaaaaatgtaatataactcgacaatattttgtttacttttttaaaagatatcaactgtgaaatgagtgatttctattggttggtgaaccttaaggtttactctaggggtacaccaagattaagtccaaaaaatataggataatttggtgcctccatgtcaagtatctagtgatttttatgtcttaagaagttaagactcaacctgagtttgaccaaattctctcgcataaacttcttatcttaaatatttaaaatcatcaacaaaacactaaacataaactcctaaactctaaaccatgaatcctaaatctggaatccttgggtaaatccggaacccttgggtaaatccagaatccgaataaattatacattttgacccataaaagaaactttcatatttatgaaatttacccaaataaatgataaattattcataaaattatataaatttatggataattttcataaatctgggtaaatttaataaacttggaaacctacatagatctttcattttttgtcaaaatggtaggaagaacaaatttgtctacatttatcttaaatattaaaaatcatcaacaaaacactaaacctaaaatcctaaactctaaaccttgaatcctaaatccggaacccttgggtaaatccagaaccattgggtaaatccagaatctgaaacaatctggaacccttggataaatccggaaccctatgtctaacgtttaatacaatctaattcactataactcaagaaataagtatacgtatacataagatgtacgaatatctaaggtgttcgaatatataaggtgtacgtatacataagtatacataaggtgtacgaataccttaggtgtacaaatacctaaggtgtacgaatacctaaggtatacagaaggtgtacgaatacataaggtgtacgaatatcaacataactcatctaatacttaagatgtacaaatacataaggtgtacatatacataagtatacataaggtgtacaaatacataaaatatacgaataccaacataacccatcgaatacttaaggtgtacgaatacacaagtatatgtatacataagtatacatatatttaaggtatacgaatacatcggtgtacgaatacataacatctatgaataccttttgtttatatcccttattgcattggagagtttaaatacatattaagtataaaatttaaatacttctacgaatacaacgagagcacagtgctctccaaaacaattatacgttaattatttagaactcacattttactctatataaaatttaaatattttgctaataacctattggtattataatctaaaattttgtcaatctcattatagatgatctaattaactaaaaggtggtaaaaacaatgaaataatttataacaacatttcatttgtaaaagctgatataccaaaatattttcattaaattcaataaaataaattaacatattagtttaattgtgttttcatatatgtgaagcacattcatttagacaacataatttttcatataaaatttaagattgtttagaaatgaaatgttgaaataaataagtgaaatacatcttataataaaaaaactaaacaattaaatattttttataataaaaagctaaacaattaaaaaactaaacaattaaagattaaacaataaataattgacattaaagacatctaaaatgaaatataatgaaagatttctttaaaaaaaatacatcatatttttattatgaaatatataatacagttacaaaaaaaatcaataaaatcgaaataaaatctagataatttttcaatagaaaaatgacattttctattaattgtttagtttttctcaataaaatcacagccatgaaaactagaattttagatggatataagatgttttaatagaaaatagacattatattatcttgtattattcaaagattttttaaaaactaaattattaaaagataatgaaatataatttaaacaattaaaagataatgaaatatttttttaaaaaccaaacaataaaattgaaatctaacctagataatttttcccattagattacttttaagaaatcaatttttaaattttaataaacatttttagtatttatacttttaataattaataaatgatatatagtatttttgtatgatattaagcattcattttaatcatttttagtgtataaatattacatttaggtgtcatatgtataaatttcataaacaggggcttggaatgtacatgagcgtaattgtttcttattcttcagttgaagaaaaaatgatttttcttcttcagttaatttaattgtaaaggtggtggtgtagaaaagaatgagagagaaaaaagaagatgagaggaaaagaaggagagggagatgattttcgtagatgatggttggtggtgtggaaaagaaggagagagaaaaagaaggaaagagaaaaagaatgagagaggtggtgtgacaaattaaagaatgagagatgtgatgtgacaaattttattttagatatattttaattgaaatggcaaagatgtaaataatgaatctaacaaaggtcccaaaggatatttagacataagtttacatgggcaaatgcaaaaagttgcccaattggctaatttaaacttgaggtcgcccaattccctatttcaaacttgtgatttgcccaatttgccaattttttcttcttttattcatcctccaactgatatcctgcaaaacaaacacaccaaaccgtttatgcaagcttccctgatgctacagcaaaagctgcagctcttctccagaaacttaaaggtaagcaacgaaatttgaaaacaaaattgttgaatgacatacccacactcatctgcagatcctcaagcattgccactgccctttttagttcctctttactccataaaccagtcagcatattgcggatagtaatggtatcaggatacacaccacttgccatcatctcctggaaaatatctagagccccattaatattacccactttacgaaaaccatgaatcaaagtgatgtaagtaattgcgttagcaactatccctcttcgacccatctcgcagaaaagctccagcccatcatcaacccttcctgccttacagtatccattaatgagtgtagtaaaggtcactacgtttggagagaagctcttgctacccatcgaatcaaacatttgtgtagcctcatctaggcggctttgcttgcataaaccatggatcactgagttataggtgatagtatctgggactatacctctgtgtggcatctcctcgtataattcctcggcctctaaaaacttcccttcattgatcaagccactgatcaatatattgtaagtttgaacatcaggttccacaccattaaaggggtgactagcatcaatatccatcttactcttctgcatagccttaaacatttccaatgcatcttttagtttcccattatcgcagagaccgtccagcaaagtgttacaagtaacgacattagggcacacaccactagagaccatctcctgtagaaggtcttgagcagcattaagatcgcccacctgacagaacccgtgaataagagtggtgtaagtaattgtgttagcaactaatcctgcttcagtcatctcatggagaagttttattccatcatctaccctcttagctctacagtatccggctatgagagtattgaaagtgattatgtccggagagcagcccttggtagccatcaaataaaacatgtgctcagcagcatcaagacgattctgtttgcaaaatccatcgatcattgaactatatgtgattgtactagggattataccccttggaagcatctcatcgtataattcttcagcctcaaagaatttgccttccttgacaaatgcattgatcaaagcattataagttacaacatcagggctgatcttcttcctttctaacatttcttgcaacaactgctgggcttcactccatctaccagagctacaaaatccattaatcatacagctgtaggtaaataaattgggaaagattcccttgtcttgcatttcactgaaaagattttgagcatcggtatgacgtccgtctttccaaaggccagattaccacattgggtttgatgtggctcacctcctccatcttcctcagaagattcaatgcagacacagtgtctcccatcttacacatcccatccacgattgttccataagtaatctggttaggctggagaccatcttctagcatccgatcaagcagagctacagcttcgacaactcgaccctcacggcaaagaccgttcatcagcgtggtgaaggttacgacatttggtttacacatttgatgaaacaaatccaaggcttcagagatcctgtcttccacacataatccgtggagcagggtgctgaaggtaacaacagtgggatgaaaaccaagcttggtgatcttaccaaatgtagacaaagcaaacggcagcttagagcagctgcagaaacacttcatcaggatggtgaagctgtatgcgttacatggaacccgcctcatttccatcttcctatggagagaaatcacaacatcgagccttcccatcctcaccacaactcccatcaatttacagaaatcaattactgaaggtaaaggacgagatcgtaccatatcaccgaacaaatcaatcgcatcttctaaccctttgatttcgtgaaatccgcttcgcagcttcaaactctctcctccaaaaccactctctccatccctgcttttcttggccagagcatgacgaatcgatctcgtacagaacaatctagccgcagacacagcaggagaagaagaagatccggatctataaaccctagccaacatttttgcttcgcctgaactttgttcttcgtcgatctctaaaaccactctcgactgagtggctagtaaaccggttccatttgatttacaacaaccggttcaatttgaattatacaatttccggttcagagttgaacccactcagcgcgtcggtcccgtcaagctaataatttctttaaaaaaaaaaaaaattctctcctctttgggcagttaacaataactaaactgatcaaccaatgttccaatgtaacaaaaaaaaaacattatcctataaaagtagttaaacattaccctataaaagtaggttgaaagattttcaccgaaatcaagttaaatagaacgataataccgactgattaagctggtctgacacattctatgttatagaattttccaattctgactatgagtaccaaaagagaataaaccaaaaaaaaaagactttcttattcgaagtaattgctggaatgctggattaggtaaggtcacatcttccttttgtaacttcactctgactctcctacaaagacatgttcacaaattacaaaccaactcattcttgttatgagaaatgaaagacagcaaaatggagtttcaaatgctttgcagcaatcttattaatctcaatgcactttaggttttcacatgtatcactgaaactgctttttcaccaggtagctacaatttttctttgaattactaaccatttcttggtattcggcatcctaattctcatcaacaaagcaatcaacaaagagcaatcaacaagagcagattaatgccctgctaatacaaataccagcagaccatcctgataccttaaaagtgctcaataagttattggcattaaccaactacctaaactcccattttgatgttaaactacctaatctgaaatattcagaatgaatttttgggaatcctatttccctcctgctcgaccctatttgctcagagctcataattggcatcataattatatccgcaatattttccaggttacgtcaaatcaaccaagttacaaagaaaatgatgaacatattaaaactaataacaactttaggaatctatatttttataagagctcagcttacttcagttgagtactgatcttacgtcaacaagtggatcagatcttttttgtcataggctcatagcagacaaatcaattcacctcacaactcttctctcgagggttaagaaatcatgttgaggaagcttttgtccaatctcccatcatataacatattagtgagtaaaccaaaggttgaagcatcttcagaaaacccgcaacctctcatttctttgatgagttctgctgatacagaaatgtcaccatttctaagatgtgctctgattagcacattataggtacggtcatctcaaagagacccatcttctttcatttttataaataagtcatccgcttcctgtagtatagacgttttgtacccaatcctgagattatcgtattgtatgttataacatcgggctgcaatcctttgaggctgaggctattgaataaatgttgtacgtcttccactttcccagcctcgcacatcccttcaatgataatgttgtaagtgaagatataaacttctatttgaggctgaggcctgaaaaaaattggatattttcaaatacttaggatattttggataaaacatattaggataattttggatgaatcaaatattttataataatttagtttttcaaatattttagatatttttaatagatttttaaattttatatatattttttgttatgtaattatgttatatgtatgtaatatatatatatatatatatataccctttcgattatatattcaagtgttcgttcggtttcaattctgttcggttatttcgaatatataaatttagcaatcattcgaatatttaagagttttagtccagtttaattatgggtattttgatttggatccgtccggttcagttataggtatttctattcagttccgattcatttcttgggttccaatttttttgcccagaactactaattagcaagacataccaaatgaacacttattatctatttcgttactgaagcatctaagactcactggaacttggctggaaaatatgtttacaaatgcgatcaaatatatatgcacaaatttttttaaaaaaaaactacacaaagacagccatatacaacaactgacaacgtcaaatatttattacaaaaccaataaagagagacaataaactatctctaagatcctgaacataatttgggattctaaattcagattctatataactactagatcttaaggagaagccttgaaagttagctaagtgtgcctgattgcatcacagggaaggaccaatcgctgctgttcttggtcgaatctctatgctcatcatcaccggtcaaatgtatctcatcggtggtgccgaaatcgaattctttattggatccggaggaggaatgttgagctgcttcttgatcagacgcttcagggaacgttgttctcagcttcttatcaacgcatctaatgaaatgatccgcatcaagatcgaacgaaaccggtttgttcggtctcacaatcttgttctgctctttaggagttgtaacagacttggagcaacgcagtttaccagggctcagcagctttggtggatcagagacttgaaactgagcgagtccgtcaggaaacggagaagtcgcaccagaaccggacataaccgagctgggggagataagctgagcgagtggactaccgggaggaagttggtaaaactgaaactcgtagttagacaccggagacctgacaccgtagttactgctggagttaaagagctgagcgaaagggacttcaggcgaagacggtgtggtggtggttaagtagaaagactcgtcgagaggcggcgtgaccggagctgaagacggttcggttgtgtaagtagagaaaaccggaggagaaaccagctgaggttcgtgagcgtaaggtccgatggcgaagatcgaaggacgttcttcgctgttgttgttgttgttgtggctgttagaaggtagaggactaaaggagaggatccctacaggtgactgtgtagcggaaggaggttctgattggaagaaggaagctggagaggaaggtggggctatgaaaggaagagccgtcataaccgaacgataaccggaattggatgtggaatcggtaggaaccggttcaggagcaagagcagctttcccgattcgttttcttctctgtgttgaaggtctgaaacatatgaaacgattccaccatcttcgcttcttctgctattcaaattttttttttttgattgaagtcacataaacaaattagaatctattgtgaatgagtcaatagagaaacgtagctatggagttcgcctacaaactttgttcgatctaatgcttttgcgataacgaaatcattatacagttctctagatgatcactaaaacctcgagaaaatgagctaaatccgatgaaatagggactcacatgaatcggggaaggttggtgatgaacacgatcatcagaggaagcgaacgcagtagcggctgcgtttatagtctccaaaacgttgtttccactcgcgccgcctctcatcttcctctgatcttatataactttccggagaaaacaaaacagagcattcgaatttctctcaaagtatcaatacacagaaaaaaaaggactatgaaaatcaatgtctcctgtgagtaaagttgaaaaacaatttataaataacgaagacacgcaacccgaaagttctgggaatattgtttctctcttgagaaaatatatagatacacaaaccagcatacgtgtgtgttatatgtatgtgtatgtgtgtcaaggtttgaggtcaaaacacggcaaagaacaaaaggcgtgcctactattcattttgtaaattgatgtgatttgaagggtaattaggtctattaaacttgcgaagaatttgacttctttccttttttgtttttttttgtttttttttcaaattaattttaagataaatttaaatttatcagtttttatttcattctgatttaaagattttcattttatcgtgaatatttcactacttttctggtcactatttcactaattatagattagtacaagaataaaatgagattagcaaattgatggtgctgttcgtttgctcatctgggtgatccatctaggtgaagatgcaagttgatgtttgttttgtacattaaaatgctacatccagatggatcacccaactgcatttatgaaaattcatctcaaattctcacccaaatgagggtgagtcttcacggagcatctggatgaaggtgagtcttcaccaaaaatttgataaatttttcgttaaaacaaaataaattcttgccaaaaccgaaaaatgcaattttccgtcaaaattagaaaacacaatttctcgtcaaaatctgaaaaacataatttcgccaaaaccagaaaacgtaatttcccgtcaaaatcgaaaaatgcaatatcccgccaaaatcggaaaaaggcaatttcccaccaaaaatcggaaaacccaatttctcgccaagaccaaaaaacacactttcacgccaaaaccgagaaaacgcaattttccgtcaaaaccgaaaaacacaatttcccgccaaaaccgacaaacataatttcccaccaaaatcgaaaaacgcaatttcccgtccaaaccggaaaaacacaatttctcgtcaaaaccggaaaacgtaattttcccgccaaaaccggaaaaacgtaattttccgccaaaaccggaaaaacgtaatttctcgtgaaaaccggaaaacgcattttcccgccaaaaccggaaaaacgtaattttccgccaaaaccggaaaaacgtaatttctcgccaaaactggaaaacacaatttcccaccaaaaccgagaaaacgcaatttcccgccaaaactgagaagacacaatttctcgtgaaaaccggaaaaacgcaatttctggccaaaaccgggaaaacgcaatgtcccgccaaaaccggaaaatgtaatttctcgccaaaaccggaaaaacacactttcccaccaaaaccgagaaaacgcaatttctcgccaaaaacgaaattttccggcaaaaccgaaaatgtagtttcccgtcaaaattggaaaaacacaatttttcgtcaaaaccggaaaaatgcaatatcccgccaaaattttaaaaacaattctattttaattattttaataacaagttcatctcgatgtagatgcaagttgaaaaaagcaaacaaacatagttgcatttagatgattcatctggatggataaacgaaatgcagagacgaacaacatctagatgaagtatttggataaggcatcaagatagaccatctggatgcatttttgagatgtacaaacgaacagggccatattcttacgaacataaagattgagatgtttttgttttattttttatttttcatgacgagataagtgtcacagaaacgcacgtgtgggagaatcgaatctatctcttttagttttaggtttctcgtgtgcacattagtgtggggctaaactaagtaatttaaaattattaaataaattatatattttgaattagaaatgatgtcacaacttctggcccctaaaaacattattatctcacaaagccaatttcaacttgttttgcacggtggcttgacttcatgttttgggtcttgtttacttttctatctctccatacccaataattaaacgaatttcctataaatgctttatggaaaccataattcaatcttttggcacattataatttaatcgttaaatagcccgcagaagctgatagccactttgtaacttgttagaaaatggattactgtttgtatttgtccaattgactgattcttggttccaaaaaggggacataacttattgaatcatttacacaaaaacggaagacaggcacagttaatgtgatttggtgcaaaaatgtttagctgtctgtcaatcaaataaatacgcagatctttccagattcttgaaatttttcatattagttgggaaattcattttaatatcccaaaaatatagaatttgaaagagttttctgttaaattataataggtgagggttataaaaacataattactacttaacattacaataaatagataacataaaaatgaagaaaaagatcaaaagaattaaaaagacgtttttaaataagatttttttaaaaagtttaagacattaaaaaattgttttatcattaatctaatttttgtatttaaattttaattttaatgtggagctacattaatattaatattatgttatcaaatatttttttaggatcctttagtattgatgttgttagaattaagtctaaaaagttaactatgaaaaagatagaaaaactagaaaatgatgacttttactaccaagtttaagaatacactaggttttggtccgcactttaaaagtgcgagacttttttgttataatttagtacaaaaaattcaaagatgatatttataaaaacattttattattatattgaaactctgatatggattgtcgatatcaaaatcaaaataagtttttcctaccatatatcttaggggtgggcacttcgattatcttctcggttcgattcaggatcgggttggtttgtttagtttggttctagtaatttctaactgaagtaaatcatagttagtttggttcggtttctcggttcggtttagtttcaaaccgaaccattcgggttggaaaatcttcaatcgaattatttgaaaaagatttcggttcgatttgaatcggtatcgggtcgattagttccgtttgactcggttcggtttgaattttttgtccacccctgatatatctaaaccgtgcatttcttgaaatatcttatcgtggtaaccgatgatccatactttaacagcgaggttattttgtttgtacattttaatttgaaaatataaatattttgatccgtgtttctgaagccaagtaatttatggtttgaaattatagtaaatttacatttttctattttatcatatataatttatgttaagattcacatagatattatattttaattatttttcagtgagttcaaactttgtatctttaataaaatttgaatatgcgataaattatcattttttccagcttaaaggtggatgagtaatcatttattagaaatgttattttctgtcctattattattattataaaatattgctttcaatttgattttaaaactagaaatggaacacttattttggaatttgtaaaaataaatataatagtataatatatagtatcgaataatttcaaagttattttcatataataaaaatgtatatgtatcgttcttttgtttgaatttaactaattaggtatgtgcagtaaagtgccatcactaagttatgttataatcatataaactccacctatctatgttagcaatgatgataatatatattgaaacaaaaaaaataaaaatgtaaatttacataggaaaaaaacgtatatgtactatcacatatacaaataaaaatgtgactatttaattcaaattctatgtgaaactatattaggctgaatattttttgttcagattttctaaagatctcttcaaaatattttaggtaatttaaatattaaatatttaatatatttcagtggcatttctgtaaatagtttgaaaaactaaaggaatgtttgaaaaatatatgctgttttaattgtattgatttgtcatgttatttttggtagtcattggtaaactttttacttggttactctctccgtcttcaaaaaaaaattataaagaaaatataactaatattcataattaaatttattatttatttaaaaatatactttctgataactatcagctaacaatatttaattaatttaaatattctcaattaatgtttttaaaaaatatacaaaatagctttaaaatatataaaaagtctatttttgtgaaacaaaaaaaaatctagaaaaatttattttcagggaatagtttttaggaaaaaacactttctagaaaactatagcaacttcaatagttttctggcttaatacttttaatataatgttgtctgaaactaaaaatcaaaccttactgaaattataataagctgaaacagtttacaaaccaaaaaatcaacatttagttctcatgtaaaagtaaatttccggcctaagaaactgatttatccaaaagtaattctatactactcccaccataataatatatgtcatatttggtttcaatatttacaaacctgtaacttttttaagtaacttggacaatagagagatgtaagcacatatatttttattgaaatgatcttttgttaaatattttaccatctatttataaacaaatgtaaagttatttagttcgtagactcgtagttataccaggaaaatgaatttgagctttgtgaattagatttatgtcgttatctgaaatgaaatagaaagaatatcatcgttaaagttgagcacattagttagcaaaagaaaaaactgagcacattattgtccatttttttcttttaagacttgtcggcagttcaatgagttaggtcatcaaccgcacttccggactcgtgctttgacacatgtcaccaacccaccttgcactcaaagacacaacacagtttaaaaataagagatcatgaaactgggatacaattatactcttattcaattttgataattgtactcttattcaatattgacaacaattagtttcaaaaaaaaaatttgacaacaattttttttttgcaatgagataataagatgacaccagctttcacgtgcatcaaagttggatgaaaaaggacaagaagtttacgtgatatttcttccaaagtaaaagccacaccaaaataaaagttaagaaccataaaagtcaaattaaaataatatactccaagattcgaacttatcattaaaagttcctttactgcaaatttacaaagcaagcaacagcagattcaataaaggttcaaatttaatggcagggcatcaggtttggtgtagaaaatcatttggcaagatagactagaaatgataagaacagaacctgaatttcaaagagaaggtacgagcttcagcattgtaagaggatgtcactttgacgactggcgtcccagcttgagggtacctaaaatatcaatattgtatatccttattagaatgaaaacgataatattcacaagacattccacagtagaaatatgactaaccattgcaagaaattagcaaaatctgcattgtttgcatcacgcatagcagcaaagaagtcttcacaggtcacagcttgctcatcgtgtctttgaaaataaagatcaattccctgtaacatatgcacacacagaagtgagcgtaaggaccacgaaataagacctagatactggatacacaaaaaagagtattggaaatcaacctttcggaaaccctcacttcctagtagagttttgtacatcctcacaacctcagctccctaagaaaacattatatagtcaccttcagagactcggtatatttggctgtgtcattacatatcaatttatggcgcaaccttatctgggaaagttggggctagtgcgaagtgacataggtgttgatagaattccagactgcattaaagatctccaacggttaaaaaatcaaagtatattttgctgtccaaaacttgcataactgcccgagcttcctaggtcgctcacaacactaagagtatatagatgtgaatcactggagacaatatagtaccgttccctttaggttctgagattgaggatatctatttccctgactgctacagattgggtcgtgaagcaaggagagtaattacccagcatccgttgcaggaatgcctacctggcatacacatatacctgcagggttccagtacctacctatctgttcaaaagcctacctatttaagttttgtgtggtggttttccctaaacatggaaatggtagaacatagtggtattgaattactgtgttacatacgcatgaatggttgccctacgaagaggagaacattttcttttgatcttccaatccaatcagaacatctgtttatatttcacgccatagtgtttaaggaagaagacctacagcatgaacaatatcgccagatatgtttcctgttcagcaccacatcccaggaagtcgaaattattgaatgtggcgtccagatcgtgagggacagaagtggcagaaaaagaagcgacgccgatgctgtgaatataaatcacaacaacaactgttggaagacgacgatgaaagtctctacggtagccttgactatatatgatgcaccaagagtagctaccattaaggattttgctaagtctctttcttcactttttattttcctattgagtttgattccgagtgttcctttttatagcttactaaaggaacataaagacttgataagtgattatttcacatcattcttttccttctgagttcgatttgaagtgttacttttgtgtaacttccttttaagacttgggtatgtgatcttgtcgttgtatttactcatcagacaatgttcagtagttgtgtatagacttcagctacctactcgttttgcattttgttaacttttcaaagaaattctacgtctgctgggaagatgttgacgttgcccaaactgctcttgtttagctgttgagattttcaagtgttcttttgaatagcttttattgttttacaccttgactacagttattaggaagtatacctgggaaagtgtcttcttcctcgtatatttagggtcctaatatgttgtggggctccatttagaacaaaacaatagctgttctgttttaatggtttatgaaaatgcagaaacgtctcaatggaatgatatgatcatatgttgtggacaggcacatacagagtacatttatatgaatcatgggcttgttggaagaactagacttcattagaaagagatgaagtttccttcaaaagaagtctcgcctgaacaagaagaaagcagaacaagccaaaagcgacaacaacaaggatccataaaaagttccagtttcaggtaataacttgcgtagaataagtgacaaaatatttagtttgaatatggcacacaagattagacaagaagacgttgacgaaaaaaaaaaaaaaaacaagaagaccataaccggttgaatgccggtttaaaacttaacatctaaccggtaaccggactagccattctcatttgaaaacaactaataagcgaagaaaattcagctcaagtcaacacactgagtgaaaggactttaccatcttcacatctggctcatcgggagagactttcatcgatactctgctctcatggcttcttcttcctcttcttcctcgcctcgcacatggagataccgcgtcttcacgagcttccacggacctgacgtccgcaaaaccttcctcactcacctacgcaagcagtttaactgcaacgggatatcgatgttcgacgatcaagggatcgagagaggccacaccatcgcccctgctctcacacaagcgatcagagaatcgaggatctctatcgtggtgttaacgaagcactatgcttcttccaggtggtgtttggatgagcttttggggattctgaaatgcaaggaagagatcgggcagatagtgatgaccatcttctacggagtagatccttccgatgttcggaaacaaaccggagatttcgggaaagtcttcaaggacacatgccgtcgtaaaacagaggaagagaggcgaagatggagccaagctttgaccgatgtgggaaacatagctggggaacactttctcaactggtttgtttgctttttcttcactcttgtacctttcttgattctcacatatgaacgtaatctcttgttttagggacaaggaatcggagatgattgaaaagattgcgagagatgtctcaaacaagcttaatgctacaatctctagggattttgaagacatggttggtattgaagcacacttggataagatgcagtctttgttacatttagatgatgaggatggagctatgtttgctggaatctgtggccctgctggcattggtaagactaccattgctagggctctacatagtcgactctctagcagttttcatcttacttgttttatggagaatcttcgaggaagctgtaatagtggtctcgacgagtatggattgaaactgcgtttacaagagctacttctttcaaagatttttaaccagaatgatatgaggatataccatttaggtgcgataccgcaaagaatgtgtgaccaaaaagttcttatcattcttgatgatgtggacgatctgcagcagcttgaggctctggctgatgaaactaactggtttggtgatggaagcaggattgtggtgaccacggaagatcaagagcttttggagcaacatggtatcaacaatacatactatgtggatcttccgactgacgacgaggctcgtaagattttttgtagatatgctttcagacggagcttaacaccatatggttttgaaactcttgtcgaaagaacaacagagctttgtggcaaacttccttttggtctccgtgttcaattttacgcggaaagaaagaagacgactgggaaagtatattgcaaaggctagaaaatagcaatataccaaagatcgatgcagtacttagagttggatacgacagtttacatgagaacgaacaaactctgtttctcctcattgccatcttcttcaactaccaagacgatggtcacgtgaaaacaatgctcgctgacactaacttggatgtcagactcggcttgaaaactctcgcttataagtctctcacaaaaatatctagccaaggaaaaatagtgatgcacaagttactacaacaagtgggcagacaagcagttcaaagacaagagccttggaaacgtcggatcttaattgatcctcaagagatctgcgatgttcttgagccttggaaacgccaagtcctaactgataccgatgagattcgcgatgtccttgaaaatgattctgtacgttcattttcttctatctgttacaccggttcatttagcaaaggcctatagatgttaccaccttttgttctaacataatttcctttattttgaattttttttttagggtagtagaaatttgatgggggtatcttttgatatgtctacaatcttacacgacatggatattagcgcaagagcttttacaagtatgcgtaatcttcgatttctcaaggtctacaaaacaagatgtgatacaaatgttagagtgcatttacccgaggacatggagtttccacctcgtctgaggttattacactgggaggtatacccgagaaagtttcttcctcgtacattttgtactgaacatcttgtggaactctatttaagagataccgagctcgagcaattatgggagggaacccaggttggttattttattttattttctgtttgtgtgtactttggatagtgtttaatggtttttactggtttgtgaaattttatataaatctaaatggaatatagaaaacaatgaaccttaaaaaccaaatatgtggaagttacagtagcatcgtcaattttgttaagagtttcaaacatatgtatgattcccatcatttcataacattaatatggtattgtgctgttttacattcagcccctcacaaatctcaagaagatgtttttgggttcgtgcctgtatcttaaggaacttccggatcttgcaaaagctacaaacctagagaaattgaggttggatcggtgcaggagtttggtagagattcattcctctgttggaaaccttcataaactagagagtttggaagtggctttctgttataatctacaggttgttccgaatcttttcaacttggcatctcttgaatcattcatgatggtgggatgctaccaactgaggagtcttccagatatttctacgaccatcacagaactctcaatcccagacacactgttagaagagtttactgaaccaattaggctctggtctcaccttcagagactcgatatatatggctgtggggaaaatttggagcaagtgcgaagtgacatagctgttgagagaattccagactgcatcaaagatctccaacggttagaagaactaactatattttgctgtccaaaacttgtatcactgccagagctccctaggtcgctcacattactaatagtatacgaatgtgattcactggagacactagcacctttccctttaggttctgagattgaagctctctcttttcccgaatgcttcagattggatcgagaagcaaggagagtaattacccagctgcaatcatcatgggtatgcctacctggaagaaatatacctgcggagttccatcaccgggttataggaaatttcttggccatatgctcaaatgcataccgatttaagctttgtgccgtggtttcccctaaacaggtgatggtggaagatgaagatatagaattactgtgtcacatactcataaatggttgccccatgaagagccccattaagagcatatataatcttaggattagaatccaatcagaacatctgtttatatttccctccacaatgctcaaggaagaccgacagcttggacaatacagtgagatattgttcaaatttagcaccacatctcagaacactgaaattattaaatgtggtgtccaaatcttgagggacagaagaagctgtgattctaagtcagaacaagacgacgatgaaagtctctacagcagccttgactatgatgcaccaagagtagataccattaagtattttgctaagcttctctcttcactttttattttccttttaagtttgattccgagtgttcttttttacagcttactaaaggaacataaagacttgataagtgattatttcacatcattcttttccttgtgagttcaatttcaggtggttcctttgtataacttccttttaagactggggtatgtgatcatgtcctagtcatctttgtattttacatttttacccgtcaagacaatgttcattagttgtgtatggacttcagctatctagtcgttttttaattttgttcacgttgttgacaagatgttgaagttttcaagtgctcttttgtatagcttttacacattgactacggttattacttattaggaagtatacccaggaaagtgtcttcttcctcgtatatgttgtgggactccatttagaacagaacaatagctgtgtttttttttgttctttgcttgacttgggaatggtttttgaaacagctaagcgacgaacatcttaaaagtcaacccacgtgacgtcttcttcttcacatatggctcatccgtagagacttttttttttctttgacatcgtagagactttcatcgctaactctaattctcatggcttctaaatcttcttcctcttcctcgtctcgcacatggagataccgcgtcttcgcaagcttccacggacctgacgtccgcaaaaccttcctcactcatctacgcaagcagttcaccaacaacgggatttcgatgttcgacgatcaagcgatcgagagaggccacaccattgctccttctctcgcacaagcgatcagagaatcaaggatctctatcgttgtgtttagaactatgcttcttccaggtggtgtttggatgagcttttgggaattctgaaatgcaaggaagagatggggcagatagtgatgaccatcttctatggagtagatccttctgatgttcggaaacaaaccggagatttcgggaaagtcttcaaggaaacatgccgtcgcaaaacagaggaagagaggcgaagatggagccaagctttgaccgatgtgggaaacattgccggggaacactttctcaactggtttgtttgctttttcttcactctttgtatctttcttgattctcatatatgaacttaatctcttgttttagggacaaggaatcggagatgattgaaaagattgctagagatgtctcaaacaaacttaatgctaccatctctagggactttgaagacatggttggtattgaagcacacttggatgagatgaactctttgttacatttagatgatgaggatggagctatgtttgttggaatctgtggccctgcaggcattggcaagactaccattgctagggctttacatagccgactctccagcactttccagcatacctgttttatggagaaccttagaggaagctgtaacagtggtactgacgagtatggattgaagttgcgtttacaagagctacttctttccaagatttttaaccaaaatggtgtaaaactatttcatttaggtgccataaaggaaaggttatgcgacctaaaagttcttatcgttcttgatgatgtggacgatctgcagcagcttgaggctttggctgacgatactaactggtttggtgatggaagcaggattatcgtaaccacggaagatcaagagattttggagcaacatggtatcagcaatacataccgtgtggatttcccaactcaagtagatgctcgtcagatcttttgtagatttgcttttagacagctctctgcaccccatggttttgaaaaacttgttgacagagtaataaagctttgcagcaaccttcctttgggtctccgtgtcatgggctcgtctttacgcagaaagaaagtagacgactgggaaggtatactgcagagactagagaatagctttgatcaaaagattgatgcagtacttagagtcggatataacagtttgcataaggatgaccagttcctgtttctcctcattgcatgcttcttcaactacaaagacgatgatcacgtgaaagcaatgctcgttgatagtaacttggatgttagactcggcttgaaaaatctcgtgtataaatctctcatacagatatccgcagaaggaaccatagtaatgcacaagttattacaacaagtgggtagagaagcggttcatttgcaagatcctaggaaacgccaaatcctaatagattctcaccagatttgtgatgtcctcgaaaatgattctgtaagttgttttttttctcctttcttctttttatatgattatgctaatattttattttatttggaaatataatgattttaggatggtacaagtgtgatgggtatatcctttgatacatccacaatcccaaacggagtgtatataagcgcgcaagggtttagacgaatgcgtgatcttcggtttctcagcatctacgagacaagacgtgatcctaatgttagagtgcatttacctgaggacatgagttttccacctcttctaaggttattacactgggaggtatatccaggaaagtgtcttcctcatactcttaggcccgaacatcttgtggaactctgttttgttaacagcatgctcgagcagctttggcaaggagtccaggtttgttacttatatttgaacacactggtttaaagtttagaaatctatataactaaatgtgaagtaattttgaggaaaaaaagtacttttgatatttttttaaaaacataaacaataatataaaaaatgagtatcatgttgtttgaaaaaatggatagcaatatattaaaaaaaaataataatttactgttaattaagaaaaattagaagtctattatataatcataaaacaagatttaaactttatatacatatttaaaataaaaataacttaaaaatgatttatatcgaaaattgattcaaaaatttacatatatttaaaatttgatttttactaaaatattttccactaaccttataaaatatttggaatgtatataaaatgtacaatacaaagccaaattttaaataccaagttaaattatggtttttataattcacattaagtttgaaaatataattcacatttaaaaaatattttttctaaaataatcatcaaataaaatttatttatatacatatttcaaataaaaataataatttataaaattgatttatatcaaaaattgattcaaaaatatacatatgctcaaaaattgatttttactaaaatatttttcaataaccactataaaaaaaaatattttctatatatatatatatatatataaatacaataaaactctaatttcaaacaccaacttaaattatggtatttctatttcttttaaaaatataatatatgtgatagtttatataataatacgtataaaaactattatacaatgacataatacaaaatagtgacatagaaaacaaatagtaatttttctttgaaaaacaacatccgcgcgggtgcgtaaacaaagtctagttatcattatatatttgataaaatttacaagttttatattttatctaagctttggcaaggagtgcaggtttgttattacgtttgaacaccgtctggtttttaaatttagaaattttatcattgtatattgattgttttacattcagcctcttacaaatctcaagaagatggacttgtccgggtcactgagtttgaaggaagtccctgatctttcaaatgctacaagtctcaagagattaaatctaacaggttgctggagtttggtagagattccttcctctattggagaccttcataaactggaggagctggagatgaatttatgtgtaagtgtacaggtttttccgactctactcaacttggcatctcttgaatcactcaggatggtaggatgctggcaactaagcaaaattcctgatcttccaaccaacatcaaatcacttgtagtcggggaaacaatgctacaagagtttcctgaatcagtcaggctttggtctcaccttcatagtctcaacatatatggcagtgtcctcacagtgccacttttggaaaccacgtcgcaagaattctccctcgctgctgctacgattgagaggattccagattggatcaaagattttaatgggctaaggtttctttacatagctggctgcacgaaacttggatcactgccagagctccctccctcgcttagaaaactaatagtagacaactgtgagtcactagagacggtctgttttccttgcgacactccaacaactgattatctctacttccccaactgcttcatgttgtgccaagaagcaaagagagtaatcacacagcaatcattgagagcttacttcccaggaaaagagatgcctgctgcagagttcgatgatcatcgatcatttggaagttccttgaccatcatccgtccggctatctgcaagtttaggatttgcctggtgctttctcctgcaccggatatggaagaagcttatttcaaattactgtttcgcatacgtgcaaaaggttgtcccagtgatgatgacatgctttcgttagatctcgctaaaatccaaggggagcatctttttatatttcacattgagtttgttgaacatcacgaggagatggtgttcaaattcagcacctcatcccacgaagtcgacgttattgaatgcggtgtacaggtcttgacagatgaaaccagcagaagaagcaatgaatcttgttcagaacaagtgtctgaagacggggatgatattctatcggatgatgataagagcaatgagatttatgaacccagagtaaagatatttacgggttatacaatgtttctttctttagtttttacgttccttttgagtttgatttcaagtctaattctgtatagattcctaaagaactaaaacttgagtgtatgatattgtttgtgttggactttctatctatctacccattcgatagcggtcaccagtagtaatttcacccgtttaaaattttgttcatcatggattcatggatacagttggaggctagatagatggtgactttaccattgttgggagaatgctcttgttgtctcgagtttcttattgattgaaaatctaattccccttggtgatatgtaatctggaaaactatgttagatcgtaagttgataatgaaaggatccatcaaattatccaacttgaaaaataacacatactgtgtctactttgcatggacttcctcattttggaaactcgtaggtgcaaatagtaaaataagtaaataactatgggtgaatgttcattctttcaacttgatataaaagaaaaacatcatttcgttagagaaaaagtacataacataaaaagaaaaacatgtgacgttcaggataagtttattattgtaaagtgcatgcgttgaatgtaaaaagctcataacatgataattcggagctacgagtagaaatgtctttaaaaaggatttgattcttgatgtggtctctcaagcagccaagctcttagaggcaatctcaaatacattttcagataacccattagctgacattatcatctccaactgtgcctgtcaaaccaccacaaaacacaaacacaacagcttcattcatccagacatcttctcttaggattataaaaccaacaaaaatgctaatgattttgttgtgtgtgtgagagaaaaagagagacttagttaccttggccagagcttgtcgggtttcatcgtagcgcttccacctcgaaaacgcagataccatacgagaagcaacctagaccacacaggaaagaaaaaaaaagaaacaagttgtaaaggttgtttatttttgtcaagaaagttaatacgggagtcaaacctgaggattgattttgtctaactggacaacaatgtcacccaagaacttgtaacctgatccatcttttgcatggaaattcactggcgaaccgcagaaccctccaatgagcgagtaaacctgaatggtcgtcgcattgtttcatcgttagcatacatctgagaaagaaagttgcggaacgaataagagttttgagaattcacttgccttgtttggattgcgcagatcaaaagctgggtgatccaaaagcttcttgacattctccacattcccgggaatgtcggatgatgcttgaaggaggaaccatttattaacaacctgagatcagaagccagataaagctcagtatggcatattttaaacatggaggcagagggaagtaacgtgtgacattgaagatctataccaagtaatcgccctgccacttgttatagaaatcagcaagaacctcatcacgggtttgacccggcttttgtgcaagagctgccaaagcagcaatttggtctgtcaaattggtggccgacttgtattcacccaatgcaagttccacgtatgctggatcctcaagcgatgcaagataagctggcattatttcaacaaagcaaacacacaaagaagttagtgacttccgcacaaagagagactcgtttaacttaataatgactcgcaaatgccaacctagagcagtgttcttcaaagcacgcctagccatattggggtggtcaaagacataagcctcagtgctcctattgttctcaacctgcacaaaaatataacaacagtttgaaaagtttcagtgaataaacagcgagttcaaacgaaataaaaaaacaggaacttcctaacttcagccgacactgacttgggtctcaaaagatttactatgtagaaagaagaagacatactatctttagaagctcagttttaagttcagatgcaagctgctttctaacaaactttctaacggcatgaacagcatcaggatccgccacggccatcatgtccataatctctccctccccaggtaatgttattgccttggctataaattcctacaccaatagattaagaaaaagataaaagattaagaagtcgtatcctatgctacgcttccttgtttgactacgtggtccataagggaatgtatagtcgtaccttgtccaagctcgagtcagaaagcacgctgccgagaccctgaatgaactttgggtttagaaccaatggtttgttttgttggaaatcagaaactaagttcagcatgagcttccttgccagaacttgacctgcctcccacctaaaaatacagaataaatgaatgaacgaactgcgcgtaaatgaaaaaagatctaaaatgttgtggaaaggcacataccgattgaattcatctgaatcatgggctaagaggaagaacagatcatcatcagagagatcagtctcaacacgaactggggcactgaatcctctaaacagagacggcacaggtttttctgatatatcagagaacacaaactcttcttctttctgtacgtaaacaaaacataaggtccggaaagaaattgaaaacactggacgtggaatagagtggagggcgatgtaacgtagactacatacattacaaaaggtcacgtaacgtattgctttaagaaaggaattctgaactaaccttggtcactcgaaggattgtgctgctgcttgaaatggtctgaagtgtaccattatggtaaacagaggaaagtgtaatgtcttttccacttgagtccagaagaccaacaaccactggaataaatgttggttcttttgttggctggcccggagtcgggggtatctcctgactggaaaagttatcaattacaaagcaagccaatgtgtcaacagcagattcaataaaggttcaattgtaacggcagggtatcaagtttggtgtagaaggtcatttggcaaaacagactagaaatgttaagaacagaacctgaatttcaaagagaaggtacgagcttcagcattgtaagaggatgccactttgacgactggcgttccagcttgagagtacctaaaatatcaatattgtatatccttattattaggatgaaaacaataatcttcacaagacattcacggttgaaatatgacttaccattgcaagaaattagcaaaatctgcattgtttgcatcacgcatagcagcaaagaagtcttcacaggtcacagcttgctcatcatgtctttgaaaataaagatcaataccctgtaacatatgcacaaacagaggtgagcgtaaggaaaacgaaataagacctagatactggatacacaagaaaaaagagtattggaaagcaacctttcggaaaccctcacttcctagtagagttttgtacatcctcacaacctcagctccctaagaaaacattatatagtcagctaaggttttttgcttactgcatataacagcaacattatcatcgagacaaaccttttcataaacctgaaacgaaaacaaaaaccaaatcattctgttagaatcaatacataagggactgataggaaatgaaactaaatagagaaaaataatcttagattccctaccgtcactgatagagcagggtgatagccaggcacgtaatccaagattggaacagttgcaaaaaacacaagcacgttagattggaacccaatacaaatagtaaccagatgaaagcctataacagaatcccagacttcttagcaaacagaaacttgcctgtgtagaagttgtccatctgcacagaaagttaaaagagcaatgtttatcaacacgaacgtaacatgcacaacatagtttcaggaaaagatatgtaacaagactctgaccttgatgtatgaatgtgggcgaacaggatgtgccataggaccagcatcctggataattaaacaacagaggattggcttagaaaaaacgagataaacccatgtagtgacctaaaggagcacaagactaggtacctgcgggaattgatagatcctgagctttgaaacatcagcaatacgctttacagtacggcttcccatatcagatgaaaactcctgtaaggaattggagaaaaataatcattagctagagaaaaatttacaacacgaatcttcatattatgaaggataatttatgtacctgatcacggaagacagttagaccttcctttagactgagttggaaccagtcacggcatgtcaccctatcatcacaaatagagtttcagttataaagacaagcatataagcaaaactggaagatccaaccaacaagaatcaaatcatttgtaaattttaataactaataaggtaagataaatgaggctgacctgttgcctgtccaattgtggaagtactgcacagcaaaaatgaaagacacggcataagatttcaatagaaaaaaacatgcacaacataaaatttcaataaacagcataatgtacgattacatacttcatgaccaataactcccaaaattgcagcataatctgcatctgttgcagtttctggagatgccaggacaagcttggaattaaaaatctgcaaggtagagaagctcatatatttccatcaagacaaaatatcagcacaagtacgttattgttataaagtaaagtagaattacgttcaaactcttgttttccatggctcccctgaaaatggaaaataaatcaattagtttgattattctcgacagtaagaaaagtaaaaagacagggaagcatgagctctttattttggatagaattcactatttgttcatacatgttaaaatctggaacggcgacaatgttgaagagatccaggtcatactcaaggccaaacacctagaggaaccggttaagacacaaaaaaacatcagattcgatacctaacaaatacatgcaatactaaaaaaacttttcaaagtacttacatcttcatcccacttcatggccgccttcagagaatacatggcatgagcagtctttggtagatcttctgcaggagtccagattttcagagatacctccctaccagagcgtgtagtaaatgtatcatctctgctcgctagctgtccagccaccagagcaaatagatagcatggcttcttgaaaggatcctcccataaggcaaagtgccgacctccctacaaattaacgaagaggatatgcgttcagtaatgacaaagtgagaggacatttattccagaaaagggtcactattttgctaacctctacatctccttgagaaatgaggtttccgttggacaacagtacaggatagagtgacttgtcagcttcaacacggcatgtgtacttcgccataatatcaggacggtcctaatcattgcatattaaaaacactatgtaagaacatcaattgtactttctcaacaagagtcatcttatatagaagtggcaaccaacctggtaaaatgtgattttccggaaaccctctgcttcacattgtgtgcaaaaattcccagatgacttgtagagcccctaacagaataaacttaaaaaggttaaaactgttctggtagatcattaaagatagcaggaaaagaaaaaagttgaaggaacagatgcagaaaagtttacatcaagtgaagtattcttgtgggggtatatctcagtatcaatttccagaacaaaggactcctcggccggcagtgaaggcagagtgagatgacgagaatccaactggtaatccccttcctaatcaaagtgaaagagagaccaagtaactaaaccaaactgatttacatatattctaccctacggagttgattttactaatataaaaatgaaaattagtactacatagaataaaagagtatgtatgcttaaattgatacctttagaagcttcccctcaaccttgacagagagtagcttcaagtcatgcccattcaagaccaagggagcagaagatcctgggcaacagaatacttgttcagaatgtgatgtgaaaaaaaatggaagaaacaaagatgaatgttctgcttgagtaaagtgttaatgtcaaaaactagtaatgtactagactgttgtacctttaactcgaggggaaactttgatcttggagctaacaattgtcttctcttcacctagagagaagcttagatccacctaaacaaacaaacaaacaaaaagaggttcagattaaaacaatggtgattctacacataggctcaaactgaattttaaagaagggaagcatacagtttcaaagtagtaatcaggcttggtgtagtccttgagaaagatttccttaggtgcatccattttggattcttcaactgattcggtggcaacagaacaaatcagcctcctgctgctgtctcgcttatatctctgacatatacaacaaaaaagatggatttaattttgcttcataaaaatccagcattggggttatatttatcatagaggaaggaaagggagagttacatcgacagaatatgatagaaactgattcttgctcaaacaagtaacctgagacagagaaacaaaactgaagaccaatctcaactttaagtaacagttcagttggttgagaaaacgaaagaaacacaaaacctgggaagtaagaaagggtctgtattgagtaagtctctttgctgaattacgtaacggaagtgaaccgcttcttaagggaccctacaaacaagagaaaactgaaagataaattaaactacaaaagcgaaattaagggaaatgaatacaaaagcaaagctaaccctaaacaacatatgcatattatacgagtgatcaaaaaagtcaaagctagtggccatatacaaactcaatcatttcgatttagaatctttaaccaaaggaaccaaaaaacattaatccaaaacgcaattgtaaaactttaacaaacattaatcgatttggacctttaaccgaaggaacaacaaaagaaatcaaaacaagagagacagagagagagtttagagagtaatcacaggaggagcacgagagatcaaaccgagaaggttgaacctagtggccaaagacgacgagcttcgacaaggaagtatcaatcgagccataacacccaaaaatcaagctattaaaaccctagaaaacactctccactacagagaatcaatcaaaacacacagtaagagaaaaccagagcgacaaggctagggctgcggactttataagggatgtgttaatcggatagcatttaaatgaaaaagaaaattatggccacgaaaattcaatattaatattaacaaacaaacaaacaaaaaattgatcttgcgattcgagtgatgatcaaaatcgataggaggaagaagacgagattaatacccgagatctgcgattatcagatgaaggaggcacaactcatataatcacaagaagaaaaatgctttgctttgcgtgctctgctgatatatttatataaccaaaaaaaaaagatatttttcgctaacaaaagaaaaaggataaaaaggaataacagaaattatttgtattttattattgtgtcttatccaatttcctatcgctgcactttagcacctcgaggttactctattccaaaaaaaatcagtgtttctgaaaaaaaaaaatatttccaaaacatataactgtgactaataaaatttaattggttaacaaatatagaaaataactaatgacaaaaaaataatgtataagactattagtaatcaaaattttatattttttttggatatagtaagaactcgaaaacatacattttttgaaatagagagtaatttatttttggtcaacaactcaactgaagaagagaggtgtattttactatttcaaccggataaagaagaggttacaacaaatcgatgctaattctagttaaccaataaccaaaatcgcaattttctctaacatatcatggtaaacagagtttgacaaagacttgttgaagtatagttggcttcataagcggtgcatttaagaacaacttatttgaaaaattaaaatttcatcaataacattattgatctgtttcagcatattatatcggcaacaatatgcaattgcctcaaccacatagaaatggcctagaaccatagaaaaaaaaatctcaacaaatagcttttttcttgtataaaaacaaccccttatagcctaattagctaatgccttcacagctttctctgctgcgtcatccaaatcatcagctgttatgagtttcattccactttccttgaggattctctttccttgttcaacatttgttccttccagacgaaccaccactggtactttcagtgacacctatcatgtggggtttggtttcgcacaaaactctatcaattaactatttatgtttatatatgatgaaatatgtatgcttcgttttgctcacctctttagcagcattcacaattccactagcaatcacatcacatttcattatcccaccgaatatgttcaccaatattgctttcactttatcgtccgatgtcagtatcttaaacgcctccaccacctattattatcacagccttttggttaaactggtttaaacctaacaagcttgatagccagagatactacgaagaacatgttttccttacctggtgttcagaagcgtttccaccaacgtcaaggaaatttgcgggagtcccaccgtgcagtttaatgatgtccatggttgcatggccaatccagcaccattcaccatgcagccaatctctccatctaaaccgatatagttcaggtccacttttgcagcagccacctacgagatgaaacgacacactttccttcatcaagcttgataataaaaactaaaagtgtaacataattttttattgtaacctttctgatttatttaaccttaactggtatatacacattatcttgtgtacaggaagagtattactaactggcaaactaatcaacaagctgactaacaacgagaaaaccaataacaacaaaaactatttaccctatccagattcatgataccattttctagagttgaacatccataagctttgatataacataggtttcttggtgaagaacatacgatacgatgcaatggaccatacctctcgtggatcctcctgcgttggatcacgaagggcaaaaatctctttctgacggaaagcagcattatcatcaaagttcaacttagcatcagcagctaccaattggttcgtggatgtctcagcgagagggttgatctaacagagaaaaagtaagggttcaacaaaagatattgaacttgtgtataataaacaagacacagagagaatgctcacttccaacatagtgcagtcactcttgcggaagagttcgtaaagcttcttcacttgttcaatcgaatcttttctgtcagcagcttttggagccagaccatccacaaccttggcagcatcctcatctgtaatacctgcaaatacatcgatcggtacctacagaaaaccatggaatgagggtcaaaattggctcaaccagagtaggaatacttgtggtgatgaaacacaaatcaaaccttaataatcatgtcagggaacttctcagcaagatcttcaatgctggtaccaccctttttacaggcaattataagctgaaagaaggtattaaagagatgaacgacaagatcattcctgagcagtaagagaaatggattttgcatatttattattttcaggcagcagcataccggtccagcagatttacggtcgagaataatggaaaagtacatctcattgacgagtgacaacttctcacacaagtagacctgctcaaaaaaaaataaaaaaaaaatataggaaacaagaccgctgagcaaaacttacaaaacgctaaaaatcagtatgatcttcatcaaacacacaaaccttgctgactactttgccttgaggaccagtttgtttggtgacgagaacttgcccaagcatcttgcctacaaaaagataataataataacaataacaacaacctgaatcggatcaagaaactctgatgagagaaaaaagaaagtgcgtgtgcaaaacaagtaccagcaatatcttgaacctgatcacgtttgacaatgtgaacaccaccttgaagaccactcttgaaagtcccgagacctcttccaccagccaagatctggctcttaacgaccaactgtatattaacaacacgaccctcccatgagacaaaacaaactatttgttggcaataatgaaagctcttatacagtacctcggtttcattagggaaaacttgttggatagcgtttttgacttcatcgagggaagagacagcgactccgttgggcacgtttactccgtatttacccatcagctctgctccctgtcagagagataattgatattcaaaaataaaagaattacagattcgatgaagacagccttgtcgttcgtcagatcgtgtcctaatttcgcattcggaaacagttgggaaagcgaatctaggtagagagaaaaaaaggaaggagaagaacctgatactcgtggatgttgagacggcgaagctgttggtgctgccatttgccggagacggagagagatctggacacgagcttcttcaccaatcccctcatccttttgatttttgtcttacggtaaaaaaaaatgaaaatcgatcagagaagtatagagagagagagaggaagagaatagtcgcagcgagtctagggtttttaattttctcaaatgatcgatctttctcccttaagaaatgagagtatttcgtttgtttttctaagaaaaaaaaaacattccataaaaatacaatacaaatataacttctgtcttttcttttccacaaaaatcacaaataaataagtactattggccaattggcccaatcccggacttttctacttatttttgactaattttattcacaaaaggtacataaaattaactgaagaaactagggatagatgttcggtttcggactttcaaatattttgatatatgaatatagagcttctttgagtatctttaaactttggatcggatactgatattacagaccggatttgattatttaaagttatttagaaaataagagcaagataaacatagttctgttatgtaccagattgtgatcgacataaccggaccgaccaggactgtacccaccataggagataatgcttatcgactgttgtacttatccacttaggataaacacgacctgatgtatctatatatgtaagactcttggttgagattaataacaagaaacacgtttccccacttagttttataacacgttatcagcacgagactctgaaatcccgagctacctcaaaaaccctaattgacggcaccacttcaaacagttctttctctccaaccgtaaggatccaaacgatgatccacatatcagattgaagctcttgacgagacgaatccaacgccgtcggccacgcctctatctgacttcggacgcgccctcacgctctattataaaacgcgacgtcaagtgatctaaaaccctgaaattctaaaactcatccgacgacttcaaacagtttgttctctcaaaccgtaaggatccagacgacgcgtaatatatcaaatcgcagctctcgacgaaacgaatccaacgccgtaaacctcgtgtcaatccgatctcggacgctccctcacactctgtttcaatacgcgccgccagtaaccctaaaaactttaattttggcgcaacttcagaaaacgagtaatatatcaaattgaagctcttgacgagacgaacagatcaccataaaccttgtgtcgatccgatcttagacgcgctttcacgctctatttcaataagcgccgccagaaaccctaaaaaccctaaaactctaatctcctcttttgttttacgatttgtgtttgatcattattttaacttgtttttgactcttatgtttaaggtctaaccaagatcaaacccttggttcatagattccattcaacccaattggaggttaagaagaggcgaccaattttttatccgttccggtcatgcagttcgcgatccggctcgttcctgctctcagtggtccggttctacaaacatcaaagtttaggtaattaaaattctgaaatctaaaagagaacccatactgaatttggttgtattgataaaggtttaagactaataaaatttgcaaaaccccaaaccctaagataatagatcccaaaatcctttgagtaagttggagctttcaagtccaacagagattgtttctaacaattaaactcaaaaccctaatggttttgaatctcacagcttgatctattgatctataaagtaactaaaaccctaaatatgacctattatgtattatggtctaaaaattaattaaaattcatgataatctcctaaaaatccccaaagttagttttccatcatcagaatccgacccattggtctggaactatgtgaaaaacgatttttcggtttctggtcagaaattgaccccttcaaataaattccgaaaaattaattaaaattcaccaaaaaccatgataaatcctaactaagaaaccatataagtagtttcttcagattcgtttttaatcacatagtcatagtgtaaatttttcataccgaaaaagtgcataaaaagtgtgtgattgtttgaattatttgaataacctagaaacgattgttaggatctcattctgattttggttgaatcattggagattgcttgaaaaatttcggatttttccagattgcaaagttgcaaattttacttttttcaaaactttccggttttgtgaaaattaactttttatggtttctgaaaacttccatattagttttagaataatggaagattggtaaaactagtttaaaaccataatagaacgttttccagattgatagaatgcaaaattaacttttctaaaaacttctatttttgagaaattgtcttttataagttgctggaaacttttcatttttcttttggaagattagaaaaatgctataattgttaagattgatctgatttttttttaagtcatataatggtttcgaaaataattattaaaaaatgaaaccatatattttcgaaaccctaaacccttttttctctctctttagaatccgataatattttaaatcatctagaatcaattatttgatctgatttatatttttttccatcttgatcatgtagacaatgattgctaaggttgcatcataaaacattttttttaattgattgatcatatgagaaaatcagattgctagattgaaagaaaaattggattgcattgcgtaaattcagaggttgaaagaaactaaaatctgcattgctatattgactaaaaaaaaattggattgaattataaataaatggttgaaagaaaccaaatcacattgcataaataaaaggttgaaagaaaccaaaatgcattgtttgaatccgattataagtcaaataataagactctaaaatctatattttcagatgtcgaatttggattatcaagcccttaatctctctggagataattatttaaaatgggctatgaacactgcaattgtcctgaagataagaggacttgacagatgtatcatcaaaggcgagtatgcagctgaaaatgaaaaatatggggcaataacaattattcgccaacatctcactgaggatctcagagatcagtatctaaatattgcgaaccctctagaccttcggacagagttaaaatccagatacacaatagtgtcattaccaaaatttataactcaaatgggtcttttatttgagtggataaatctcagatttcgggactttaggtccgtagatgaatataactcagctctaatcaaaatcgtttctaaattgaaactatgtggtgaagaggtaacagaggaagatttactggaaaagtcattcctcgcagctgatccaagggatctattgttacaatatacctacagaaaaaatgtttcaccacttatacgaatttgatctcgtatctattacaagctgagaagaataatgagatactaaagaaaaccagtgagatgagactttctgaagccaataaggctggagagaataagggtgaatccaaagaagccacgtccagaataataaaaggagtggtcggcttatacattgcctaagaatcgagatttcgacattctgattttatgttttgatttgtttgtcatttatattttttttatataataagaattgttttagttttatattatcatgtttgacttgcttgataatttcttgaatgataaatgacaaatgattttttttttaagaaaaaagagtatagtaattaaaattatccgaccaaaggcattgcctaaagggggcatgaattattcacccaaataaaagacccatttgagttataaatttttgaaaatgaatggtttccacattgaaccaatgggcaaaagaaatataaattccttaagattataaagaaagtaaaaatcgcccaaggcataaaaatggtcgagactgtactcccaactgatctaaactatgctaaaagattagtatgataaaggcaaaaggcctagataaccagataggttgaccacgaaattttatacactttatggcatgactggactagccatccaagtatttaaaattgatgcaaagattgatatcgaaaaaaggcacaaaagagttatcccatagaatctcacgttgtgtaacatgtacacaagggaaactcaataggctataatgttccaagcatctaaaatatttatagcatgtacatgagggggagaaatgacactcccgtggtccatgaacaacactaaaaccagtgaaaaataggtcatgtgtgggaaagaaaaagaaatcgtgagacatggactaaggtgttcatattcatatttacagcattcaaagaatggcttgattatacaaggatactcacaaagaccaaggaacagattataaggagatgtactcctatgtggtggatgctactacaaattcgaaaatgataaaggtctggatataagaaaagagaaatgtagtaagcagcatgattgatcactggataaagatgataagagtatcagaaagatgagaaaagaaattctcatagaatagttttgttcctaagctattcatggattgaaacaaggcagttgcaaatgatagactaagaaaatagttagtacaatcagtccatagatccttatagaggatattataattccttgtgtttatgtttataccaaaccaacctaaagagaggttcaatggttcaatgatttcaatgatacaagttatcgattgattttggacagaatatgatgggagtagaaaccttagccatatatgagtatattggcgtgtgatgacaaggtctatgacttaacatgtatgttttcgaaaacatagcattgtctacgacaaaatgaaagaagtcatgagacatcatccagagaaagtgaccagaagaatgtctgagtcaataataaaatgaaagtttccacggtatggcaaagccatgagactagaggaaccgtgggacatgagaggacctgcaagaaagatttaatcgcaggatagaggtacatccaagtactggtcgagtactatccgagtactgattgagcatcatccatccgaccagaacatgaagacattgtcgagtggtcagcatcaaaggagcacgtcttgaccatgtccaaatgaagttccagaaagccggcgaaattacaaagtattacaagaagctcatcgaccagataggaatgcatcgtccaaagatctacagtgatgcattcatcagggggagttcatgtgttgtactttttttcctgtccatggttttccattttgccacattggttttagggttttccaggagaggttttaatgaggcaacattaagcatgcaacgaaccagtactggatgtgtcgatcaaagaggagtgttatgtaccagattgtgatcgacataaccggaccgaccaggaccgtaccgaccgtaggagataatgcttatcgactgttgtacttatccacttaggataaacacgacctgatgtatatatatatgtaagactcttggtcgagattaataacaagaaacacgtttccccacttagttttataacaagttcataaatcaaaacaaaaaaaaaagtgaatcatataataatttgtaagttgtaagatgaaacgatatagtatcaaataaacaaaaacaaaataaatagttaatcaaagagcagaacatcaagtaatcaaagataaaaagcaatagttcactgaagtaatcttagaaaaagaatatccctccgtaaattgaaaagtatgattagatttaatgtgaactattgaaaagtgtgattagatttaatgtgaactataaagaattagtttaatttatcaatatttataaattcaaacctctaattcatatatacatgatccttgatcattatcaagaccgtctaccagacattatatggtaagactgtttggtactgatatcaagggaaaacacaacggatcgcaagtgtttgggtgcaaagtacttgatcttggcgtgaatgctgaagagaaagatatgttatctcattgttgagtctatcatgtcagtaaaacaaacagagtaaaaagatcaaagttgacaagtattcttagcttggcaatgacgatacaaaaacaaatctgtagtgacctcaattaacaacaaagggttcattcacaagaacggtttctagatggtccagtatattcttggcttgacaagaaccaaagtattggtctgcatcttgagaaagtatcctacagcccaagagctttcttcatcaaacgtacgcagaagtggaatcactcgattgagagcgaacgaaactatgaacttcttgggtaagagcttcggcactgaggagacagagcgtgagaaacattatgaagtgccgtcacaaacaaatctaccagaaacttgtaatgaaacgaaattacgactcaaaagatacacagagaagaaaccgagaaacctctgtttcagtctcttcaccagtttactgtattggttgtattggtattttttttttttgaggggagaaaacgacagcatattggaaacaagtcattgtggggagaaaaacgatggcgtattaagtgtgagatgttgtttatttacgtcccatatcgttaatagacagggaagtcaagctatttataaagtgcagagtcgaagctagaggtcacgaccttacttgaacaggatctgttctataggctcgtacctctgtatccttgatttctaaggagacaggccctcaaacctggttgatgaatcaaggccgtgcgatctgagtgtgattaacggttgtgatactcctcggaggctccgcactgtagaggatcgctatccggttaggtcttgatctctccagagtggtcgcacggttgtctgacaggctttcttttttcgtttatgagagtatggttggcattgatgaggatgttataactttcaaggcataaacctcaacagtcgcctcacctacttgagttatattgcttttgttagcagagtttcactctgtcatattctttgggttctcgctgtaagaaaaatgattaaagctttcgttgattctacatttctcatattgttatttctggcatttttgccattgtgatagcagacttttgaactttcttgctggtccgggtactctctttacctcaggggcagcctttgaaataggcatatgatcatgtgggaagaaactcagactttagggaacaaatattggaccgggaagaaaaaagggatagaagatccataaagttgaaaaatatgggcaagtggacatgtactgattagcaatattattaccaaaccttgaagcataaaaatttgctgatctctgagttaatttgtgaagttgaaacatattataatgtaacatgctcaaaactatcccacaattgcttctttatcatgagtcatatctgtatttctgcctgcagccatgtttattagaatgatgcagatataagtcatttgggctctgtgtcttctaaagctcagactcattcagacaagagtgatctagattgttactttctgcctgccgttttgattctcaaacttataattttattttcttagtagaatgatgagcagaagaacttaggtgaactctgggatgttatgatacaaaacacaagttgggcagacccttttctgagatattgagacacataactgaaaaaataattaaaattatacaaatagactcagttttctaccttcttagattgtaatgaactgtttggatggaaccttgaaaaaggcctatcaaaactcacaagtcacaagcagccttgaatggtggtcacaggatcatgtggaaaaagactggaaggatgggattggtactgattagttactaaccaaaccttaaaccataaaacaacatattgatcttttttttttaagttcatttgaaacataatctctaatgtacaaagttcaaaatgattccaaaatgctgttgtagttatgaaatcagtatatcttcccctgagccaccaggtttactcaaatggccggaccccgcagctcaagcccatcagtgattcacgcgcggtttccacttcccatagttgagtgtgttatgttagcaaaacaaacagagttaaaagatcaacattcacgtcttattttagtctcttcatctgctttactgtatttgccatttggtattggtattttttcttttgaggggagaaaagggctgcgtattgaaataggtcatttggggggaccaaacgatggcgtattaagtgtgagatgttgtttattacgtcccatatcgttaatagacagagaagtcaagctatctataaagtgcagagtcgaaggtggaggtcacgaccttacttgaacaggatctgttctataggctcgtacctctgtatccttgatttctaaggagacaggccctctaacctggttgatgaatcatggccgtgcgatttgagtgtgattaacggttgcgatactcctcggaggctccgcactgtagaggatcgctatccggttaggtcttgatctctccgtagtggtcgcacggttgtctgacaggcctttttttagctttgatttctttttagtgcactgaggttagaaaccgcaatgtataaagcagtgttgtttttttctccccggtaatggacagagcagtcgtgttgtttatagaacgaagccaagaaggtcgaggtcacgacattacttgaaccggatctgttctatagactcgttatttttaagctttggttgatgcttactacactcttttaagtgtttgtacatataaggcacttgagctctgtgtcgtgtcttctgaagctgaaactcattcagacaagagtgatctacagagatatttctgcctgtcgtttgactctcgacttataaatttgtttcataatagaattatgagaagaacttatgtgaactctgggatgttatgattcaaaacacaagttgggcagacccttttctgagatattttaagaaacacatatcactgaaaactagttgagattataaaaacagtctcagtttgctaccgtagattgtaaatgaactgtttggatagaagcttgagaaagtcctatcaaaaactcactagcagctgtgaaatggacacatgatcatgttgaaaaagactggaggtattaccgtattggatttgtactgatttagttactaccaaaccataacgattcaatataccctaagagaattgccacatttacttttaaactcatcacttttttttattcatttgaacgttgtatattgtattatcctttttagttagcacgtcggtgctaattctaatcatccaagaatcaaaatcgcaatttttctcaaaacaacgaaattaaaggtgaaacaaaaactttgtaaagtgtttgtttagaagccgtgcatgtgagtatcatcaatcatcattattggccgataaagcggcgttttttagcagagttcatgtagggtctaagaacccattccatctctgcttcctcttgttccattgttcctaatttcacctgcatcaccaagaaacatcatttgatatttaaggaacctgattgatatatattcattatacaatttaacaaaccaaatcgaatcaagacagaataaaccgaaacaatgcacttttacctggtagagccgcaactcaaaccgaggaccgacttcttttaactctatcgattttgggcctccttctcctttatcatacacatgattcctatttttatatatatatatatgcccagaatcattttctatcaagaatccacacaaacaaacaaacgaaaacatgcaatatcttaggacaaaaaaacttgtacctgaaagaaatataatcagatttattacggaaagtaactatacgtcttgcatccagttttggaactgggaacatgtgttttaacatgctcccaactcttttacccatctgccaaagaaaaaatacagtaaacaaactctacaaaactggtttacattggagcaaagaaggaagtgaatctgttctaacagaatatacctggcttgtaaagttgtcaaaaatgacgtaaggatattgctcagacatcttccccgttgctttcttgctttggatatcataccttgttacctaaaacaaaggctggagttgttaaaaaaaggaaagatttgaaaagacaaaaatcattaggatgcagaggtacttaccacattaagtaattgaaagtaagcagttggtccgaatgggagatgagaaacgataaggccatcaggcctaccacggttctcagtaacaaatatcacatcactataatcatgcgaacgcgccatctcaataatctcagaaatgacctgcacaaagaaacaattcagtatataaatgggtattgtgttgtataaaagtcactacaagtccagaatactcaaactcctaatagacttactcatctacacgttcaaatctttgaacctatgttacgcgtaactatctgatgtaagtaaaggcatgaatgcgatagttacagccagataacaaaatggtccaaaagggagctaaataccattagagctgaacttaacgacaaatatgagagaaaccacaaggagtgaccaattggaaaacaaaactagattatataagatgatgattagatttagtacagaaaggcagaagatgacaaatatatacctgactaccacgattcattctcttggcgttaggaaatacattcttcaactcctggcaattaaaggttataaatcaatcaccaagccccgaaacgttgtaaaaagtaacacggaagaaaacaagccacacaataattaatggtaaacatctattcaacgagagtactgaaactaaattcaatatatatatatatatatataccttaacgaatcgcgttagaggagcacttggatccctagacgtagtcatcaaaatcttgggatctttttccgttgcttttgcatattcatcatcaatatgactccctggaactactttcacaacatgattagacaaagattatccacttttagcgacaaaccacaataatgacactgacaacaagagtttcaaacgaatgagcgtatatactaactacacaaagtatgaacgtatactaattacgcaaagaatgaacgtatactaattacgcaagttcgaacagaatatattgaactatgtattgaaacaacaataacttggaacctcgagcttattaacaataagctccaattatataacacaagtagaatttagtacacaacaggcttcacaaaaaaacatgaggattcttaccggaggtgttttgatcttcaagatcaatctcctcacgaagcttcgcctcctcgtttcggagctcagatggaatcggcttcccttctgttcaaacataaacccaaatcacaacaaaaaattatagattgtttaagagagttaaaagaaaaaaataaaaaatcagtgtggaccttgcagggcttcccttatcttccgcttcttctcatagagccgacgctcttcaccttccaagtttttcatgtagagatactcctttcttaacctaatgttcctggcaaacatcttgattcgtcgtgagtgacagagagagagagagagagggtggggctaccaaggaaccagtttggtaggaaagggtttcaaaagatgcaggaggggaaggcaactacaagattgcgacagtcttataataataaaaaacggcaaggtgtttgtctatgaaaaggtgaaaccattagcaagctacttttaggccacttagtatgtgggctctaaataggccacaaaacaacactacgaaatttttgacagtgacgcagggtttaactattgagttggtgacccaatctctcaaattagtgtacagatgtgtccttgtgcttgtatatattttctattgttccatctagaccagattcttacacctaattaatagttatcttagtcactctgttgtataactagtgtcctttcgtcacacaagtgtgttaggtatgtgccggtgtttttagacatgattcagatttgcggttaaaccggtaaatacggtgatctacaactaattcagtttatattcaacgaaaatccttcaattaaaacccaacaaaatctaataaaaccaagaaactagtattaacttgtgatccgacactggttaatccggtaaaaaccacaaaatttaaaactattgcgagatcaactttgatattatcagtaataacaatttttatagtttattcagatcgactttgaatagtatctgatattcaaaatattgccctacatgatatattcatatatttttactgatttaatatatatatatatatatatatatatatatatatatatatatatatatatatatatatatatatatgtttaagttttttggttgatctcatttcaattagtaattgtcatgtctacagacaactggtttttgagtgtgtggtttggatgttagataggagaattggtgttagatcagtgaagatatgtcatacacatgatggactaatatttatttggactcatttggaaagaaacataagttattgttttctagataatattgatatatatacaacttggtagcatattattattatgttcagagctatttataaaatcagtgagattcataatgcaatgtgaaaattagagttgttgtacaaaattacagttttgcaagatgttcaagttagaagatcgattataaaatataaattttctgattgaaaatctgttacaaggtaaagttttgaagaatgcatcactaaattaacatcttaatttctatttaatttttgtagtttgtgatgcatatttttatgtagtaatttttaagtagttttgtcttgattttgtaaactagttttggtattagtgaaattgttttttcttttgcttggagaaaaatcatctattttatataaaattgaaatatgaaattgggcatggttgtttttcggtttagtttttagttttttttttgttcatttttttgttgttttagatatagaaacctttcgtaaatatgaaagacatatgcgataacaataacagtaactttttttcttcttataaggctatgtttattgcagggtttttagggtggaatttttagactaatataaaaaatgtctcttaacttttaactaataaaaaataataaccgtctcttatatagattcttagtttttttatttaaagttaaaagatctaaaaaacggttcttagttttttcttatttaaaattaagagacagtttttatattaagctaaaaacattataaggtctgcccttcaccatctgatttttaccttccagtatttactgcggctaactaaatcaaatgtaacttacagatggcttccagattcctctcgagtttggagagattaccaatggtaagtcactctcacttgaataataataattggatataacgaagtgttctatagtccacacattatatagcacaaagaatctgaagcgaaaaaactgttttaagaggcaaacaaagtggacacttgtaagttgtgagttgaatcttctccttgtctcacccttttgcgtgtgtgttgtgtgtggccactaatgtagcaacaaaaaaaaaaacagagcacgttggcagggaagagcccagacacgaagagagggagagatcttatccatggcggctattactagtctccaagcaatccatctcaaactcgggagacgtggcagcatccgatgtgggatctcggagccgagcggagagccagctccggtagggcagaagactagatacaacgatggcttagctgagagagtgttcatggggctgttcgcgaggaagatggacaagtttggtggctcgaagaagaagaagaaggatgagacgaaggagaaagagttttgggaatacgactacgagagcttcgtcgaggtttcaaagggagtgatgcaaggacgatcaagggcacagcagcaagaggttgtgagagaggttcttctctccatgctccctcccggcgctcctgaacagtttagaaagctcttcccaccgacgaaatgggctgcggagttcaatgcagctcttacggtgcctttctttcactggctggttggtccttctcaggtcatagaagtggaagtgaatggtgtgaaacagagaagtggggttcgtataaagaaatgcaggtacgctgtgactactacttgttcttgtcatgtttcaaaattgtcacagactttgcttttgctcatactgttgatatcgaaggtatctagagaacagtgggtgtgtaggaatgtgtgtgaatatgtgcaagatcccaacacaagatttcttcaccaatgagtttggtctcccactcaccatgaacccaagtaattaatctttttcctcaccatctaatcccttcttggggttttgcttacagtacttgcctatttactgttgtagattttgaagatatgagttgcgagatgatatacggacaagtgcctcctacatttgaagaagatccagccacaaaacaaccttgtttagcagacatatgtacgtcttacaaaggcctcgtatcttagtatgtaatctaacacatgaggatgttgcttgcctgcaggttctatagccaatccgagctccccagtctgtcctaaactacaagcatgaacagcattggatcagctagatgtgctatttccaaagatatacatttacatactttttctcaaacatacacagaaaagtcacaatattgtagagatttgatactggttagtattattatgtgtttctattctggttgagttgtgaaagtatccgataaatacagacacttgaccttactcatctgcatcccctctctcaatctttatcgtttgtggagtcacatgtttcagcttattagaggattcgtttgaccgaggaatcatataaaagagattgaacatagtgcttttgttagttactttttttttcttgtaaaaccttttgttagttactagagagacaaattaagaaatgtggaacaaatgagtacaaacagaaacagtgaatgtgatctgggaggtgatcattaaaagcacatggaagttttggcccaacaaacaatcttgatgagactaccagaaacattaatctgtgattgttaataattagtactagcttttgacccgtgcgtccgcacgggtttttatttatgtttataacttttaccaatgtcatagagataattatttatgttttagttatatattcatattcttgaagaaattttgtcccgttcgatgtgtttagcatccatttatataaactataaaattaggttttttcattataatgcttttgtttattctaattggtaaagtaaaattaaagtgtaaatgttaaagttttaaatatatatttgttggttttatgaaatagtagtattaatatttggactaaaggttgaatatgcataacaaatttatattgcattttaaaaaaaagtatataagttaaacagaaacgttaaattatgaaaaataacatacaaaagacggacatgactggtttttccactaccaccctcaaacgcagctctcttggttggtagcggttattggcgttttagaacaatcataaaaatgctacaatcgttttatactgttctgaacctctgaaaaacaaaaattggttctagatagcgtttgcggttgcgggtagataaaatataacagttaaaaatagaaatattcaaaaaaaaaaaattgaaacaatataaatagtaaaatgtatatattacattttaatttatattgtaaaactttaaaaggaaactattttatataatttaaaatattaatagaataattttataaatataattatatatttattataatattataattttaataatttataaatatataaaacgtgaatattgttaatttattatttaacagctactgcatttaatagtcaacagttataagtatcccgcaaatacatcaatttccaaacgctatactaattgtacaaattttaaaaatgtttaaaaccataattacctgcatccacaaacatccgcaaccgtaaatacaaccggtgcacttataccagttatgtcttcagtatattttttttgcaaattttattaagaaagactaatttaaattaaacaattggcccattttgttattatttaaaattcagtacttaataaatatacaatattgatcgtctaacagctacaaacataaattacaatacgtaatttataaaacaaatgctttgtgattataacttgggccatcaataataataagcccaaaactaatctgtccaaaacatattatttattccaaacaaaatcaccgaaatattaggctattaaacgatttagtcttgtttaggaaatacattaaatgatagagtttaattttaatggcatatgattgtaattatttaggaaaatgtagggttaattcctatttgtactctagttttaatagtttagactagagtttgacccgtacgtccgtgcgggtgttgattttattttattttcttataaattgattaatgacctttttaaacatataagtttttcttcatttttaggttcttacacatccaaaccaaatccaccagaaccttaaaactccgacttgagctccacccaaaaagttataatatccaaagagagtctaatttcaaaacccaaaaactcgatatcttaaaaaacctatcattacgtgaatgaatacatgaatatatatgcctaaatgattatgtaaagaaaaaaaatgtttttcattcacatttggaattattatgattaacacataaaataaatgacgttgaattattatgataaaaacaattaatgaagtagttaaaagtgtgaaaaagaatgtaaagaagataatataataatttaaatgggtaagttctattttgtaattgtataattaatactttcgaattattttgtaaagagaaattaataaagtaattaaaataagtgaaaataaggaaataaaatatataataagttgtaaagttaattctatttgtagtcatgtcatcaattttagtagtcttcttacattttctttgtaagggggactgtagaaaaaatatgtagcaaatcatttcgtaaataatgtctaggagatatttataaaaaccattttgtaatctaggtgtaaactgaactaacctgttaagagtcaaataagtgttcatattcttcaattttaaaaatcaattaatgattaattttaaaatttagtataatattatattaattgttcgagactaacatttcagaaaaaagtctagaccattgccaccagaatttgatttaatatattaaactgggcagatacaataataattttgatggcttcgtgttttgataaagtttaattcaaatgattattgtataagatataaaactcttgaataatgtataaaatattaaacctgaacgtaatgtttttggtaagtgacctctccggcgtaatctcaatccagttattatttaaattaatcattaattgtttgttttaattacagtggtatgaattgtaattattgtggaaaaattagggttatttcctatttgtacttcacttttaataggatagatgttaataatattatgacaaaatataggttcataaatagattaacaggggtagtttggtgaaaaaagttcaagaattcatttttcaaatttgcaaattatgtcattcttttgtatatgaagtgcaaattttcaatatactgtagtatgatactccctctgttttttaaagatgtatgttttaggaattttttttgtttcaaaaagatgtttttatattttcaatgtaatttttgtcaactaattatgaataattgtgaatctcaaaaacattaattgcatttcttaaaattttcttggtttagaaatataggaaatataaaataacaaaaaactatgcactaataattaaattttaatatgttttattaaaaagtgtgaaaatctcaaaacatgtattatttaaaaatagagggagtagtttgtaatataatgtacaagcctaaaatatcatatggcccaaaaattccaaaaaaggaaaaataaaatcttctatttttattttaagaattgttctataatctcagcattccagaagtgatttttagaaaataaatatttgtccaaaaaattatatatatttcatctatactatactaaaaggcaaatactcttaaaggagagagtatccacgttggatgattaaattagccaattagagagaagttatttatccatgtcagcattgctctgtcgacaacaaatttggtcattcatatgggcttctaaatttcgaaatggtccatgttaagccttttccttccaagcttgatcgtccatgacctttacacttcgtcttcattgtttaactctcagaaattcgccgttaccacgatcactcaaatcgattcaatatgttctttactactttcttcatgatttcgtttcacctcctttgtttttcttcctatataaagccttttacatcaacctaaacctgcagcctccacagaagaagatagagctggattcagatttcattcgatgaaatagttcaatgagaactgcaacaggagagccgatctataaggtaaatctaatatatagtttgttggtaatgtattattctctctccctgtaggtgttagattcaattatccgacttatagctgagacaaacattaacaccgtccaaatacgcagattagctaatcgatggacaaaatctacaggagctccaactactactcatacttgacagcaacagaagtcgcttgcgtacatctcctcctttacgttgttccgatacaaattccctacggctcgggaatctcgaggttttgtattatgtattatcttcctcgggtcgttcacaggtaaggaaatagtctcactgtttgtaagaattttgatctgatcacttcctttcagattttgaattactccgctttttgaggacgacagagtttcgaattgaaatgtgatggctcgcatgaacctctctcttaccgaacataaccgcgggagagatccacgtcatcatgaagtagacttcgcaatcttctctcagaaactctgttactctctgctgaaacttccccgacacgtctctgcctccaaaaacgtcgagaacgtgaagattgttatccttcttgactgtgaacgtatagttactttgctctctctctgacctcagaggtaagtaaggaacaactgtcttgatctctatcgtcacaacctctgtgaagtctctaaccagtacatgagagacgatgaagatcgtgaaaacgatgagagatatgactgaggctgcagatgctgtgaagagtgatgatcgtgagaggtttaaccgccggtgattgaacatcgccgtgaatttcttggcgatgacgttatccattttggttaagaattaaaggtaggaggagaactcagttttgtgaagtctgtgttttgttgttttcttatagtttgttttttgcttggggttgaagctgtcgtgttctgaaaagttcttaagccgccagagaacgtagacttcatttttttattattattattaacgagtggttctcaactaagcctatagtctgattacaatgcaagggagagaacaaaacggtgttcattatgtgaaaataatgaatgtgtctaacgatttcaaaggccaagaatcttggcaggttcctgtttttctttcaaaatgtaaatcaatcgtgagggtgagacagctggttacttgctgattttcgcttctaactatgctgttgaatatcataactttagttagcaagactttccgacatatttaatatttagtttaatcttgaaccagtgtaaaatagttacctcttcttagatattgtctaatgtctttaggattgatgttttcttactgcattgatactttgtaaaaggcgactagaaagaacagtgtggcttatttctaaatgttatgatcattatcattactgtcttttagatatatgtttttgctttgatattttcagccactaatccaacgtgacggaccaaagtgcaaaagatgtggaatctacgaggaagacaacttttatatatgatccatttgacccttctcattcaccgctgagagtaaatacacacacgcaaggacaacaaatttattgctacttttctctgccgtggatgctcacaagtaggggctggtgagtttccaagaacagtatatcttgagttttacattcatttctgttccttctagctttacagtttaattatggtgtaggggtgaatgtgatcattaaagatatcacatgcttattttttgtagctgaatgcatccatacatggaattgtcaaagctctctttgaatcttagtgtgggttccagaaggtaaatcagtttttactagacagtttttttttttgaagtttttgtttccacattgaagactctcctgcttatataaggtggcagaccaaactatagtgtctaagttatatctccctcaaggtttttgtagtcttctacctaaacccatgtggaatcatgcattcatgcctatgtatttgttttcctcttagtttataaaattttacacattaatcttatagagaaaaaattcctggcactataagttggtaagtgttatagagaaattttagaatctcaaatgttactttagattagaaatactgcgtcatgtgttagcatttgtttaaattatttttaaaagtaaataaatgatacaaggttctagcgacaacttgctaaacccttatttttgttttaacccagtcgttgctaaacccttatttgattagcggagacatggtcagcaggaacaaggttggtagattcacacctttgatctcagtttccttagtttgcacataatttcacagaaaaatccagattttctgattatggattatacaggagtgtggcaaaattcctggagaaagcgtttctggagcaaagggagaaaggtgaagaagaaaatgcgagtttgttacagatttgcagaggaacaactcagacggaaagcgcaagacgcttctacgagactttggatgtcacatctggtttctctgtccggttcaactttgttggatttatcggttttcaagtattggaaactctcttaattgatttgagatgggcactaacgtgttctaggtaaaaatctttgccaagactgatgactttcagaatcaggctcactttcatgaagattatgcaaggagatttaaaccaaagatatttaccgcttctgaatcttgccagagcaagttgtagttctttgatttcgttttaatgaatatatttttaagtgcagctcaacatataaaatgtcatatttgttggatgttgagcattagatccatatagattttctaaaatcgtatttcatttgttttattttatatgtcgtttaaagttatctcacacatattaaaaactacatttttgttataaccctaactaatatactattttgtctgtatttgataattaataaagtaagagaatatgaaaaagaaaagaataggaataaactgaataaatatctacattgaaaatataaaagacacctaaaatgacacaaaatttgaagtttagagtgataataattaatactccttctgtatcactataatgtgtttaaggatttcaattttattccaaaataagtgatgttcttttggttctagataaatgtagtttgaaatttgtgaccaattacaaaatactattttttattggttaaattaatttaatttaatattattttatataaccaaaataaaatattttcttaatcttggtgaaaaaccataaaaaccttttaaaatgatacaaaggaagtataaaacagaggatataatgaaaaaccagacatgaaaaaaatacaatttataaaaccgcatataaaaaatggaaactcagaattgaacagagaaccaaaaactatttaaataatttatgaatctaacagtttttatagtgacaactcaaataggtagagtgagaaatcaaattatattcaagacttaattatttttttgttatttctatttgacatatattttatatattaaaacaataaagtttagttttaaataaatcgaaaaccatattattttattttgcaatgcagtaatattatacatgtatatatatatatatacttacatatttgagttggaaactcagaattgaacagaaaaccaaaaactatttaaataatttatgaatctaacagtttttatagtgacaactcaaataggtagagtgagaaatcaaattatattcaagacttaattatttttttgttatttctatttgacatatattttatatattaaaacaataaagtttagttttaaataaatcaaaaatcatattattttattttgcaatgcagtaatattatacatgtatatatatatatacttacgtagaataatatattaatttatatttacttaaaacttatggaaataatccgggcttagcccggaaaaggttctagtatttctaaagggtcggcattctcgaagatcggtctttgaaccaatcacgaggttgctaaatcctaggtgtccacacaaaaaaacgagttgaagtcaaagttattgataattcaaagaaagtgatttgattttgaagtttcttcgttgaaaagaaaaataaataaaaagagagagagaagagtgagtgaaggagaagacgacagacaagtttgcagtttcaatttaaaggtttccgcgtacagaattaaagtatatcagatctattcacataacttgttttcgatctgtaccgtttactgatttttagggtttttggatcttctgtttagcaatggcggataaggccgagaagatgaagctccggcaagattaccggaacttatggcactccgatctcatgggaaccgtcaccgccgacactccctgtaaatctctctctctctctctctctctctcttttcgatttctctaaatcttaatcaaagaaattgatttttctttgtgcagattgttgcttgtcgtgtgtgtggtaagattagggtttgttgttgttgtttctctgtataatttggtacacagttgatatctccttctttgtttgttttattgcttgcttttgtagtggaccgtgtgtttcttacttgcttcggagaagagcactttacaatgacatgtccaggtctcaacttttttttttttatctatgtacattattattattggtattgaagatatttatttctccctttgctaagatattgtgagtctttattcttgtaggtatacttgctgtgctggatacatgccctgtagtgggaggtgtggagaaagcaaatgccctgaactctgccttgctactgaggtctcacttccattaatacatatatatcattacattaaagccgcttgtttttcggtgaacaaaatgaaacagcttacattttcttgatcattctttttttcccctatctctgtggcatttgttctaatatgagtacttttaatcccttttagacaattatttcctctttttctgtgtgtttgtactctcgtatttctgattgctttgctcatttcattttgactgagagacttacattatctctgagatccatacataccaatgaactggattttttttggcttgctggcatgagtagtcaacttgctattattcaatagtagatctcttgatgattcgacattttttttttaagaaacttgtaattgtgattttttaggttttcctctgtttcggaaactctgtggcctctactcgctttcttctccaggatgaattcaacatccagactacaaaatgcgacaattgcattattgtactctctttctctccttctgttttaacttgttttacacagaatgcatatacacatctcattctcatccttggcgttttgcagggatttatgttctgcctaagccaagtcgcttgcattttctctattgttgcttgcctcgttggtagcgaggaactctctgaagcttctcagatactctcttgctgtgccgatatggtctactgcacgtatgtttttactcttccttaattcttttcactttatcctcttagtatattaaaggtaaaaccaatgctaatacttttacgaccgtcttggtgttattttttttttttcagggtctgcgcgtgtatgcaggtataagaaagcgtgaactactaatcttttagcttctgaaatatattttcttatgttatatataaaccgaagaccaatgttatgcttgcagactcaacacaagcttgaaatggacaaaagagatggagtgtttggtcctcagccaatgggagttccaccggcacagcagatgtcccgttttgaccaacctgcccctccagtcggctaccctcctgcgtcttacccaccggctcaaggctaccctcctgcaccttacccaccggctcaaggctaccctcctgcatcttatccgcctcctggttatccccaacattgaggaactttaaaccaatatcttcatattgtgtgtcaaagtgttgttgttattactgttcagctatttttctcagttatgtggttgctttgcaagtattagtactctggtttatgcactaaaacatttggtatcatctggtgtgttgactttgttggtatttttctcccatttatctgatgaacgcaaaaatgtgtaaaccttgctatgctatatgtgtggctgtattccttttatctttgcattatctgtactgtgatttctttgcaattgcctaaccagcctgttcaagtaggctacttaacactgtcaagtagcccaaaacaatatttcggtattgttttgggatgcttttcacgatgacctatgaccaaaccggtaacatacaagggcttgccaattataaaagcacatgcgcaagcctttctcccgaagctgaatagatgagcggaatactgatcctgaggactagtcatggcattaataaccacaagttggaaactaatgtttctttcttctttattttagttatatctgttggcactctgctttgtattcctaacatgagaatccgagtagtattttttattttctcccgaacctgatttgtctataaatatctgttctttataataagatattgcgcacgagggtgggacgtggaatcatcgaggatgggctaaattgcttatgaagtttatttaagtcttgtaaaaatcttgaaaatatttttcaaaaacaaaaaaaatcttgaaaatatataacaaagctaatgattcaattcatactgccttttacgcttttaagtcaaagtgggtcaaccataataacattggaagagttgtctatcgattaatttaacgacttctcccactatatttagaaaattcagtgtagtacgtttgaagtgtaaagaaaaactaacttattcaggtatatgtagatttatcatatttcaaaatttaatcaagggatgtgctagtatatgctccatatcgcaggaaactggtactgataaaataatagaatctacaagttgatatttcttcacaatggtaaggtaaaatagtcgattcttcaagatctaaaattacattagtatattgttctggtataacatgtttagttcgccttttgcaatttagcggcggaaaattggtatttttttaaaattatagttaattatttatttatgttacttcatggtttcacaatttgccattttttgtgtacttcatggtattgtttgaaattttcaacataatgtttttatagattctatttatttttgtggtatatctgagagccaaaaaatgagtagaagcgtgtggggctcgtattagtttagaaataaataagcacacgcacagacaagtccatgtgtgcgacgtggcgacagcataacatattccaatttccaaagtttcccaacacatgcgaagcttcttcgcgtcacgctctctgccttcatactcttttgcaggaacctctcaaattatatttaataccccaatgattaagtgttgattcttaagaatgcaaaagattaacaagtctttcagttcatagaaaattctacaaaaataaaagcaacaatcctatttcaagtatacagcttaccaagatggactatgattaagcttcgctagaaagtttaatatgtacggtattaatcgtaggccccagattttagttcaaacacttacgattaaaaatcgtataaaaacacccaaattctttcatatataagagcgtgaattacaagacaaatagagatgatgaaaaaaaaccttcatacaactatacaaagcgagaattataagaaaattgatgaaaaaagttcctttacttagatacttggaaaatacattgtttaccaaattttttttttcaagtttatggtttttgatgcactttatttgcctatttttgtttttttggagaaattatttgcctatattagtccttttaacttttgagtggagagcatatagcctcttggtggaggctgcctccatcgttgattcgttgcgttgtcgttctttgactttacaaatctttaacttaactctgagataaaaaaaaaaaataacttaactctgagataagttcatctattttccgtgaaccacatgtgtcaaaaggaaatagcttcatggatcttttatcagtgaatagttatgaaaacctcaaaattttcttttgctatattttaaatttaaaaagttaacgcgtgatttacaatttgtagtgagaaactaggtagcacagaagcctactatttgacactggatgttttttaagatttcttgacaattttaataaaataggaaatattacacatttttttaacgctgatttattatgatattacaattacaattattaagaacattacatatacgattcgacaactgacaatactcatagttgcctaataaatcgcactctctctgggacttgaaatctggatttgagaaaatctgcaataaattgcatagtctgagaatcaaaccccaaacttgggtgtagaaaactttagaccttaatcattatgctaagatgcttccacagaaatattacacatttattaatttgttaatgagcaagtccaattatgtttccatctaattttttctttctcaaaataaagttgtttttgcttagataacaaaaaacctgtgaatgaacagatttattttcacggtaacagaaaaaagagtgcaaataataactcaaactttagtttccttttctgaatagatgatacaagttttcttcttcctctttcactagcctgtaaccactttctatttttaatttacatccatcagctaccaaacacaatactactaacaaaaaagtattaacaaagaaaataacctttcatgttaccctgtcaagcgagaggaaaaagaactatgtcctaagatgattgagcaagaagttcagaaacgtcttcactagattccgaccaaagcttttgactaaagtccgtttgaagctcatcaggtacaaactgggtacgacaaagcggacacgtcatctgactataatccataatccaacggtccaagcattctttatggaaaatatgcctgcaattcgtcagccgtcggatctcatcgtcgttctcgaagtcgtagagacacactgcacaacattcggattcgggtcggtttagatccgagaatctgacaacgggcaagatctgtccagctagcagcgctgctgaaaacaagtgagagtcatggtggcttgaggtggtggagtttggtggtgggtcgggccatgaagatgtaaccggttcgggttccaagaaatcgggtaaaccaatgaaccagaaaagtgtggagattagttttcgtatcaaacctaagaaagagagtacatgaatgaagatttttgggagtaggagctcggaatagcccaccggaaaacccattgcttcgccgttagagagaaaactgtaaagagagagaaatagagagagagacttttggattgtgatgaaaagatggagagggtgggatgtatatatagttggcgtgtgtatgtgtatattaatattgtatatgtgatttggtaattaattattgctccgttaatttaatggagtactcaataatgtgaaaattttcgtaggataatcttttatttagtttcttttcaataaaaaagttccaaaaaaaagaaaatgatatttttatgaaagagtaactatatatttatatttttagattaattaatttaaactgactgtttaggggtaaaggatgaggaggttttggaggtgtttttgtaaaaaaatattaaaaatagtttttaaaagtattttttaaaagtattttcgaatttataaaaaaaatgaatttgtttcgaaaagttattaaaaagttcaaatttgaaaacacataattcaaatttataaaaacattctttacttttttattttttttaattttattattatttatttatatttatatatctataaatcaagaggtagaaatgtatttagttctttaataaaacttattctggtcatttcttcttttctttttcttttttttttgtttagatgtcattttcttctttaggaacttttttattgacaaaaaactttaaaaatcgttatttgaaatgctttaatttgtttctgtttgcgtggttttctttggtatttaattattttgcttgatgaggatatagctacgaatgtggtaatgatctttctttaggttatagtatatgcatagactattgattgtttttgttcatactccctataaagataatagaaatcaagaaatataaagtattaatgtaaatccagaaatacatcaaataattaaggtaaagacagatcgttattcgttaggttcatttcattctcagtttgtcgacacctatattgcattatacatgctatgtacatgcatttatatttatactttagagattgtttttggttaccgtgaaattaggatctttaaaataattttttaaaaaaaaaatttaccttcaaagtaggatattttcacatcaatgtagattacaaaaaaaaaataaagaatgaaaattagattctactctacaaaatcaatgaaaggacatcaattcactgtactagaaaatcttaattaatcgtcacattttggcatggacaaggcgaaaatatatttatcataccaagtgtatttgatatcacaatgatgaatacacacattgagttcagtccaaaacaatgtttgaatcttcacatgactagtagagatcatcagtctacatatacgtcatttgctattatgattcttcatctattgacttttgatatgtatttttatgacctaaggtgaactacgtagaaaagcctttgcagttctttaagtttgattttgattcgtacttctagaatacaatattaatttacgtaaccaaaatatttgaagatctatttctagagagggggagtcatatgggtatctgactcaaatgtatgaaagagctaaagcagctctgacccacctcacaccctccccatcttctcctccaacatttcacattccgccattcaacactttttgcaactatatactgtatacactcacacacagaccttatatatatatataaggttgtttattcatctatgtaacttgaacaatatttcaatgaattaaaaaattcccaatttaattggatttatatgtttgataaagtagatgctttgtcatactttggaaaaattgaatccaccacatgtagaaggcgtgagaggacaaaaatcaccaggctatttgtctcccacgtacgtttatgtacagcaagtttaccacacactcatgtttatattacataggaacaagggcttacagaataattaaaaagcgtcactgttagtaagattatattaactgataagccagataaatccagccaagattaatcctttttgtctggacaattaatttaacaaccaaaattcggttaagaaaaacacggaaaatcaattattttttctttcaaattacttaggaactgcagtgttcaaaatttatagtttataccctggcaatttacattcacacataagggtttaggtaaggtgtcaacaaagttttaatgatcgttgatgactgatgtgtcatgtgtgtacgtagaattttgatccatttttagcatactattatttttttgttaacatattttcttcagtctacatgcaaatatcaaaactctaaaatgaggaaaagtaaataatttagaaacttcaaatatgttagaaacttccggtcctctcgtaacagacgagttagtaactgtgatatatatactctatggattggattatgacagcccttagtttctctagtttctctcggttattttgtaagttcatatattcatacttatcaatctaaaaccgtcaatatttgcattggtcatctggcttgaaccaatactggagtcactttgtaaaatgttaatatcatatgcactgttgtactatgtacatgtaaagagtttgttgtatatattgtattttatgtacggatattactatagtcatgacagcatgctttgcaggatttaaattattataagaaagggaacagtaaaaagtacttgaggaattttgctttaagttttaaaagtagagttaaacatatttaacttgaaccttgtctgctaattcaacggaaaactacaaagtttattccagttttgcatgtcagagactgtcgttttgtcagcaagcgaccaactaatcacactaattgttttaagcaaccagctaaactataattaaagtatccaaatatatatacttgtctttgtttatattcaataatcaattcaatatatacaaccaatttcatagttatccagattaacactcacttgactcttagatcattattgtttgtctattttctcagatatattttggtttagtttattctttttttttggttgaagaaactgaaatggtgagaagtgaggcttgatccaaggtctggtgggagagtttttttactggggaaacaccaactgatctaatgaattttttttttggttcagtatattcatgtgaatattcctaatttttgtccttgttatatttttaagaaacttttgagctattccgataatgaaattaatccgaaaatgaaattattttataactattgtaattattttctcagatgaacaagtcacactatgtcaatgattggtcatgtagactgacttggaccaagtggcttttcttttctgaatgcatttatttttctcttttaatttctttgaatgaatttaagagcatcttcaagaacaactttatatttgaagtttgctgaattttatatttgaggtttgatggtatttttattcactagtaaactctaatttttatttattttatatttgtacatcatagtctttactttagacaaaaatcaaataaaaacataaaactttataagaactaaaatcatagaataaaactattctaagtaatatttattaataaatattacattctactaaagattacacataaataaaagattttaaaatacatgactattcattattattgttattattttcacaatgttcccacatatgatcaatcagttgacattttagttttatcaaatgaacaattccttgatttcttaaaataaagtgcatcagctaggggaaaattatgatataactcaattatgtatgctaaacaagtaaagaaactaaactgtaaagaaatgcatgaggatagtaaaatgttattaacaaacaaagaatctatcgatgatcatactacttgtgagtttatcgatctgaacaagaaacattcacaaagggaagaactcaagcgtaataacaacctccaaatgaacaaaaattttatggaattttttttggtgatactagaggtagagtgataatttatcaacacaacaacaagcaattcaagctctttaaaaaaataccagaaacaacaatctagaaaatgagttcgaaacttgaacaagacaacatcatcaaacaattagtattgtcatgttttaaacaacttcgaaataataaaatgaacaaaaagatgcgttagtgtgctcgtgttccttgagaacaaatggactttgagaaaattcaaatacaattgtagcaaactggtcgtgaaatgtattgttaggcttattaggtaccaattcaatcgtatctgtgatcttttatccttgctttgacacaattagaaaccattttcaccaatcgttgtgattcataatcttctttacccaatcgatcctccttctttctcagccaaatgagacaagctcaaccattagttcaatatcgatatttcctataaacacacagaaacacgttgcagtcacacacagtaaactctacccaaatattttcttagagaggacatcaaaggttctcaatctcaagtacggttttgaagctaatatatttattaacaatgctttgcttaatatggataacatcaaaacagtggttatatacgagaaagaatgtaaaattaagctaagctcttggttgaccctttgggtagaaatattcaactttatgcaaagtgttatcagagtatctgcgccttgaccaaccctaaacaccccgactctactaataccatctagagtagagtaactaaggattatcttattatgtagtaaatgttaatactacctttgacctcctctggctcatatttttgcagccttagaatgctgattttccagaactcaatacgatctcaaccagctgaatgttgccgctcagtaaagatgccttgcgagatggcaaaaaagagaagccatccacaagtttaacgcacttcagaccccatttcaccatgaggaattcgattagatgatgcccgctgcagtataaaaatccatacacaaaaatcaccatcctaatcttttgcagatatgttatatgacaaggatgaatgaattgtgtacctcctgttatgatacgtggtgataaaaactgcatctggagaattttgaagcaggaaagagacggtggcaaagagatcatcgaacgctatatacaaaacaaaggttcgcgattcacatttcagctcatggtaacaagtaatctgggagaagtaacgactccacaagggaaaattagaaggccaaaacaaaaaggaaacagatgaactaaccacttgaatcatatagaacatctgctccaagtataatgttaggccgcagatcaaatatggttgcatcccacactccccaagtgagacccattacctgccaatagaccaccataaggtatgtttaaatgaatggagaaaacaccatgagacaaatatcttggagatacaaacaaacatatacgctacgctcctaagcgttatatatatgcgattaacgattattgttaatccagcgggcgttgaagttgaagaaagtgaaaagtagtaaacgttacattacagttgagattgttaagctcacaaactcttgtcatattctccaaaacctgcaaatgtatcatgtatggtgaaagatgagtaataaactcctagtctctgaaccaaatgagaaaacaaagcttatcaatacattttcacacctctgttttgcttgagtcatcggtaagggtgacattagctccaaccttagcagctactaaaccgggtaaagaagtgccagctcctagctacaaattacatcaaacacataaatgtcttaagaaaagaagtatataaaagtcaaaaaaagacattcattagctcaaacacagaacacaatgatgacataatcccacttctttaatgaagaaaagctaaaaaaaacaaaacattcactcaaatctttgttctcgatttcaattgagaaagcaggagtggtttgtttacctcgagaactgaagagccacgaaatcgagatcgctcttgccagacgtactcggcgaggatgacgctacaaggccaaacgaacaaaccatactcttccttcatattctacacacacaaaaaatgtcacaagccaacgatgcaaaacgaaaaccatcagaagaagaaggatagcttcatacctcgataacagatacagagatggaagtttcggaatctcctccatcatcgccatagaaatcatgctgagagatggtggtagtagtcattgtatattcttgagattttgaagttagtttttttttttaatttaagttgagtataagggaggaacggagaaacgtcccacatcggtaagaagtgaagttgaggacactattgtttgggtataaaaaggctttgggtgggttagagtaaaaacatgatccttcaggcaagtgaaaggggatatgatgagtggtaaatattctcgctttatgagagaagagcgtttcgctccgcctgttacgacaattgagcgctctcctttgtcttaccatctgatccctctcctcattggtcactttttttttttcataaaacaaattttgtttattaactataataatagttattgttttctttgaaaatacattaatatttttcaaatatacttattagataattacagtttatattcgttttagtaaaaaaatattggaactcttattatttttagtgtctttttacttgaacaacctctatttgtcttaccatcttagattcaaagctcccacgctcaataatgtcgaagtcgtgggaactgctgctgaattcgaacactatctctcttctcacttctgatgggtcaaaatctagcaagccagagccaaatgtaaaacaaatgttctgttcgacatctgatttgatgaagatgagataaaaggaataagtagatcattagaaaacgttggacgaaaactatctagttatcaaaaccgaacgtgcacatcaaagacttaagtcaaaatctttctggagcaacctcaacttctttggaattttgttgcaagatcagcattagaaaccagaaggtaggctaagacatagcaacaagcatgaatgaagaataatgaaacgcaacagaaaagagtagttttgtcttaaaaaaaaggagaaggaccataacaaacggtttgaacaaaaaaaaagaccataacaaacggaaagtgctcttattatgctgcatcaacaaagaaaacacaaacaataataaaactctaaaaactctaaaaactcaaaccagaaccttgaagtttttctttgatgatcatgtctatctttctccatttcagacgtaagataatttttcgagtcaccgacttctcctttacggaaaaaaaacttgtgctccacattgtttattgtccctgttttgttagcctccaaactgctcagattacgcagagagcagaggtccaagatcccgtccacagatccactatcttcttcttgcttagtaaaaggacatcccaagaagtccgcaagtctcttgatctgatcacgaggctcggctttcatctcctcatacctcatgaaaaggacatgctttgggtcttccaagcttcctctccagtaactcaagagatgatcccaaaaaggtccaaaatagttggttccatcgcagaactcgttaaacatagactcgagaactcttctggttggttcgattttatatatagcacagctgtaaaaccaacacgagatcaacgtgtccttcacgttcctgcacacgtacacaatcttgcaaggagagtgcttgagtgcttcgtggatcgtgtgcagtggcatgtgagtcgagaacagcctcggaggtgctgagaacttggctaggttaggacttgagctttcgtggtacacatcgatctccaagaatggtataatgccatgaggattatgatataggagaggatgatcagaagagtggttctttgatctctcaagcagagcgactgtgagggccttgagccaagtagtgcctgatttggggtacgaagcaatgattacatcagtgtcttgcggttgaaaacctctctggaaattgagacaccttggagggtgttgtaataataccaacatccttgatatttacaaatcttatgcccttggtaatctgtgtgtgaaggaagcgaagagatcaccttcctggtttcttcacttatcttgtcgtctctaaggttcgacggaagctccttcggatccatttgtgtttcttggttcttgacttcttgttactcgttacaaaaggatatgtttaagtttcaaacgaagttgtaatagatataagagaagaaattaagccagaaaacagatattgctggtaataaagacgaaacctaatttattattttatcttgaaatcggtggtggtggtctagtggcgcttgagagaattaaaaaatccaatacagtgaattcgattcaaaccccaccggccacatggatatgggttattgctttcgactcctttgaatgtccaggaaagaatttatccgtggactgtacatccatccggaggttaggtctgtgtctttaataaactcggatttaattttttttaaaaaaagaaaaaaactaatttatttcgctggtgatacgaaaaaccttaagggcttagattcatgttaagaaaatatttaacatattgaatttcattttctattaaaagaaacgaaatatttaaatatgaatgggttaaagtttggtgcataatatttaaaataagtggaacaaacattacatatatatgtatactatttttaatacaattacttattttgcattcatttatatattatgaaataataaaaaggtgatgattgtttgaataatttttggattttggattttggtttttgatttttggctttttgcttttgattttagaatttggtttttaaattttagtcttgattttttttttgtagattttactttttcaaaaaacttgaatggtaaacttagattttggtttttgtttttccagactaaaataagttattaaaataatatatttcttttaaaacaataatatacaaattattattattgtcatccttataaatatattaaaattaaattaaatatattatataaataaaataatagatataatttataataaatataattataattatatctccaggaaaatatatagatagttaagattttaaaatggaagaaatatcaataacggaattttaaaagtatatttaattctaaaaactattttaggaaaaaaatataattgtattttaaattgtaaagatacataaaattttgcaattcaaatattttaacacagaaaaataataactatatttaaaataaaaaacaagaatattataaatgtatagtaattaaaactaacaaaaattaacttaaattctatagtataggatattaattaattaactataaaattaatctatctaaacataactccaataacttaattcgtagggatgattattaatttgttctattcatatttttgtagaataaatgtaactctttcaacaaaaataaatgtatattttatatagtagatgtatttctgaatgtttctttttgcaaaataaaaagttaaaaataaagtatattttaaataactaattttatttttaaaaattttcaatttttactatatattgctttcatattatatatgttaagcaaatgattcttactaaactttatatttaattatatatttaatgcatgaatttagtaaaaaaatatttactaaaaaaagtgacaaatattgaaaaccaacgtaacttttttttagaaaccacaaaaacttttttttggtttttgtctgaaaaaacagttattgaaaaaaactatttttttttacattttagagaatccatttttttaaatcttgattgaaaagaatagtttttggaaaaaaaacaaccaaaaactatttaaaaaccacaaataatcatcctctaaataattaagaaacctgtaactattacgtatataattaaattggaatgtgcacataaatcaaattaaacaattttatttactactatttatggtaaaataattaaaaatatttctttatttgatatggtatataattatattttatataatattaacaaggagatatattatattaaaaaaattgatttgttacatttaattcttactcatatgatttataaccatttgtattattgttataaaataataaaccattgatcacaaaatattcaataaaccattgatcacaaaatattcaatgtagaacttttataattttaatatattataatctaaaaaatttaataaaaatttaaatttaaaatattaatttcttaatacttgttcaatgaaaatttgaaactaaaaaattatgtattttatatggttttcttatcataatgtattttatatggtatatagattaatttaaacaatttacaaaaaaatatattttaattagaatatctattaaatgaaacttcatatttatattgttttataatcatttatcttattataaaaaaatattgatcacaaatctttaatgtggaattttacagttttagtaatttgtaatcttttttaaaaatttgataacatataccaaaaaattaaaattttgttatataattattgtaattgtttaatttattttgactattatattttagcgagtaccatgaagtcgaacaaatagttattaaacaccataaaagtcgtgaattcattataaatatatggaaacttgtaggttgaaacttactgtaagaagactattgaagaccataaaagtcgtgaaatcattataaatatatggaaacttgtaggttgaaacttactgtaagaagactattgaagttgcttacatcttgcatatataatatatggaaacttgtaggttgaaacttactgtaagaagactattgaagaccataaaagtcgtgaaatcattataaatatatggaaaaacttgtaggttgaaacttgctgtaagaatgaactagaccatgaccttagagatgtcaaatgggcgggctataaatgggcggcccgtgtccaaattgatatggtctgaaatgaacatgcccattttgatccagtaactaaattttgtccacatggacgagcccaattataacatggacaatattgggtttaaccacttggacaatgggcggcccaaaaatctaaaatatctaggtttagcaaattggaaaaaacacaatatttttttttccaacattttccttcctgaagcctgaaagtttgatttctaactgtttatttgtgatttttgttatggaaaacataattttccgctaaaaatgaaaaacgtaattttccgctaaaatcgaaaaaacgtaatttttcgttaaaaccggaaaaacatagttgcccaccaaaaccggaaaaatgtaatttcctgccaagatcgaaaaatacaattttccaccaaaaccgaaaaatgcaatttctgccaaaaccgaaaaaccgaatttcctgtcaaaatcaaaaacgcaatttcccatcaataccgagaaacataatttctcgccaaaactaaaaacgtaattttctgcaaaaattgaaaaacgcaattttccgccaaaaccgaaaaatacaatttctcgcaaaaaccgaaaatgcaattttttgtcaaaacagaaaaacacaatttcccgcaaaaatcgaaaaaatgaaaattatattgtttacattaaatgggtgtatgggtcccatggacagcccaacaaatcatggtcttatttggttatggtctcatttggacatggttctatttgggcttcgaccaaaaatgtccaacaaaaaaatgaagcccattcggacatgcccaaacccgcccggcccgcccaattgacatctctacatgacctgcccgattgggcggtgtttatttaatttttgatttacacaaaatgatgtatttgttaatagttacttgtgatacattcagaggcgtatctactataggattaggggttcaattgacatatgtttaattatgaaataattggttttgcataggatgccaaaaagaataagcagctaaaatggtattaatgtatgtattgacacacctaaatctgagttcacatatctaaattatacttttgttatcttatttttaaaattttacatatcatgatacatgtaaaaaaaattgatgggtccgccattggatacattgagttctttttgaattaaaaaaaaacaatcaaatctgtgaaaaatattttttattacatagaaagcttaaagtgaacaatgatagattatatatgaaatatataaatcaatttagttaatttaaaatacattgaaataattgactttgagtcatatataaatcaatttaatcgactcattgttattacattttttgttagggccatagtgttttagatcaaattaagttggtctattggctcatgactcccctctcttattctaaccgacagttttgttttgtaaccgttcggtgtttagaaaacaattgtgaagaatgaaaaaaataaatatctcgactttcggtgttctcccatgccgatgacaatttcaaaactcattaatcgagggtctaatgtttgatagtatttgtgaatctgatgctttttctttacgaatcaaggtatggagtaattaaatctattttgaaataattggtttatttttcattttgtttcaaagtatattgtttgcatgtctagttacacctagttaattaataaatgtccataacatttataaagcaaatcaattgtttcctaaaaataatgtagttagcaagaatataggcaattgccccattcttaactatttacttaatcttatatttaatattgagtactctgcaagttcagttaaacagattttactggaaagaaaacatagataatttattcataagataattttttagatttattgagacctaactctatgtgaggtgaataaacattggtttagatgaaaagggaaattcaattttatcttgaaattattttaatagagaatggaagttatattttattttacgacaataaataatttcgaaattaatatcctagatctttttttttgataacaaataaataattttggaatttatttaatacaagagaagttaaattttgttttaggacaacacattaactaaactgaaaaagagaaacattaaaatagagactatctttaaataaagagagtgataaagacacatttaataaactggttaaaacaagcatttttttaggaatgttattaatagggtctaatgtttgatagtatttgtgaatctgatgttttttctttacgaatcaaggtatggagtaattaaatctcttttgaaataattggtttatttttcattctatttcaaagtatattgtttgcatgtctagttacacctagttaattaataaatgttcataacatttataaatcaaatcaattgtttcctaaaaataatgtagttagcaagaatataagcaattgcctcattcttaattatttacttaatcttatatttaatattgagtactctgcaagttcagttaaacagattttactgggaagaaaacatagataatattattcatacgataattttttagatttattgagacctaattctatgtgaggtgaataaacattggtttagatgaaaagggaaatttaattttatcttgaaattattttaatagagaatggaagttaaattttattttacgacaataaataatttcgaaattaatatcctagatctttttttttgataacaaataaataattttggaatttatttaatacaagagaatttaaattttgttttaggacaacacattaactaaactgaaaaagacaaacattaaaatagagactatctataaataaagagagtgataaagacacatttaataaactggttaaaacaagcatttttaagaatgttattaatagggttagtggcatgtaagtataattaacattgaaaacttatgggcatttcctaagtgtacttctcttttaataatagagatattgaagttgcttacatcttgcatatataatatatggaaacttgtaggttgaaacctactgtaagaagactattgaagttgcttacatcttgcataaatatatatatatatatatatatatatatatatatacgaggtaataattcatgatgtgggcatagttaaataattaattagattatttattttacgttgtattaaaaaacttgtatagttttttttctagagttagatattaaaatataattcagatatttacaaatttttgtttgaattttgtttgaatttttttcaaatcattgcaggttcggttagtaggttcggttagtgtttgagtctaggtagtcatcttagttatgtattttttttaacaaaaatccaaatatatttaagtcttcaaatttgaaaataaaaaaatataaaacataaaagttgaataatgtaacactaaacacttaaatttacataaaattagttaaatttaaacatttggataaagaacaaatggatatttttagtattttgaatttttattttagatatttacttgtgattgctttgataattttgagatattttcatatttttgaatattatagttacaaaataaaaattatattatatatagtactgtttgttctctcctagatgcggcatgtcatcgccatgtcagaaagtcaaaccctgtaatgttgatatgtgtctagccagagtaaaacacaacacctcatttatttggagtttcgtactgggctcagttgttaatttgtattgttcgggcctgtaaaaactgatagttgggctatgtatcagtaagcaataatcgtcctcgttatcgacatactctcgatgaatccaagcgttgaacatgatagaaacggcttaatccaagtatagtcgcaacttctttaacggttttaattcaatgcacctttcattatttcttttgatcttttgagtgaaacttagactagataagtctcatcccatgaaattcatcagttccattttctcaatctttgtaaactttcagcaataagaatggctaaatcttttctattcttcgaagatttgacggctgttggtcaagtatttgttaagatactcatgaagtattcgccaccgtttgagattgagccgcatttgagatcggttttggttgagtaaagatgggaactgaagattgaacggaagaaagcggccttgaccgtcaaagatggtgtcgagaggattgtagagtggaggatggggagagccatgatggatcagctggagtgttaggtttggcaagtgagctcgagacatattgtgcagggcactagaaagattcaatatatagtgattatttagtgtatttattgtatatatgttttttatcttctaatttgaattatgtctatattaaaatgtataaatttacaaaatttattagtgattactttatttttaaatctctaactaaaaattaaaggttgataaccccgtaaatctttctaaaaccatgtcatctgaaaataaatggtggtgatgatacgtgtacaaattgctttacaaatgattgttagtactgaagctctaaaatgtaaactcgtaccactaaactaaatccaaacaagtttagcgtgacgattatgtcaaaggttcaactctcaacaatgtataatttgcatttatttttatttaaatcagttacaaaaaaaaaaacaaaatccaaacaccatagatagcatattgtgaattctgaattttggtgttacaagagaactagacttttaagactagttgggcttagattaaaaaacatgtaagcccacgcatcgaatattgggaagtggccacgtcatcagctactttgcttccgacttttttttttctctgaacaatactttaattagaactttaacctaaacttataacaggaaatacaaagctcaaaagattcagaaactaagcaggcatataatatattatctcctgagactaaaagcaaatacataaacgctcagtcaaaagccacaacactcccttcataaaccaaggcaaaggatcgctggagacaatcaaaacaaagctctaaaagacaggaccaccagaaattaagaacatggaaagaccccaacattgtatgacctggcgaggccacaatgatagttgtggtaactaacaattcctacaagaactatcacgaatcacaaacaaggctagaactttaggggcaaagagaaaccaccaggacagatccgcctcacataacgctaccggcaaccgcaattggacgaaccaaagattgcggatagaacccaggccggcaaagatcagcaacggcaaagaggaggaaactgagagagctttccttaagatagcataaccgtaaaaacacgatcttccacgagcgggagaagcagaacccaggaggtcacacccaaacaccagcaacgacaataccatcaagcgatacaacagcaagggcaatcacaagacatgggttaaaccaaacaccgcgaaaataagccaaaccctgagccatagctccaaagggaaaccaaatctgaaaactcagaacgcaaaaacacttctcaatcgccacaaacgaggagctcgaacagtaacaaaggaagaagctgaggactaaaaaccgttgactgtctaaacggaggcggagccggagcgctgcttcagacgaacgaagcctaggaagccgttgcttcaccctacaaaaacagcgacgaaacagagctacactagaaaaagacaaactataaatagaaaagagcccagctccggtgctatggtagccaccggagccagcgacgagattcgcttggatctgggtttctagagagacgtggagaaagagagagaaaactttggaatctagataaaatgtcatatgattgaacgacgtttccgacttttatcgtcttcttgcctccaagccttaagcttcagaatatgtgagagagagagaggtggaagcaaataatcatccaattacaacattgtgaaactgtttagtttgtgaaaaagcttcctcgatttcaaactcatagctctcgccagcggaagatcgtcatgatcgtctttgcaaccgcgctctagtaatccagattcgatttgcttctccgttctttatccctttcgaattcgtcccttttcctgatcccaatgtgtaaatcttccaaagaagctatagattgtaaggagggagggatagcttgtgacagcacaaatgtcgtggtcgttaccacaccgccttatgttttcctatttagttttatttcctatttatcattatggaaaattatcgtttgttaagataatgatccaaagctttttccaattcggattttagcgttttatatataaggctatgcctcgatgatatatcaataataagaataaagtttacaaatcatcttcctccttattactttctgtgcaagcaatacaatatccttacaatctcaggttcttagagctgatccttcttcctacgtgatcaactcctaggtctgtgaatccccttccttctaacctgcaagcaaggttactagtttgggacttgtaccccgttatcctatctcattggtatcagatacatagactcctcaggacccaatcatggagacaaggtaaaccacatccttgagcgacatgagcaagcaaatagacgagctacgttcttcgcaaaaccagcaaactgaagaactcggtagcaaaatcaacgcactcgaagcactcatcgaaaagtacttcgctaacgctccacccccgcaacgcgacggtaaacaaacagacgcaagttctgatattacggatggaacaccgcaagctaaggctccaccagaccgttccaatccagagaacagttcctttaaacctcacgacaacaataacccacccatccatcatagcctatccgcaaggctaacaaagattggctttccaatgtttgacggctccgaactacgagaatggacctacggctgtgaacagttcttctccatcgacagcaccccaccggaattgaaggttcgtcttgcatctcttcatatgacgggaaaagcactacaatggcatcactcttaccttgccaatcgatacaacatcttttcattatggccagaatatgttgctgcgatctccgatcgtttcagtgagctttacgacgatccattagcagagttggtaagcttgaaacaaggaaacgataccatcgatgtgtatctagataaatttgattgcgccatgaccagaatcacgcttgcgccggatcacgcattgagtatattcttgacaaacatgaatcaacatctagctcttcacgtgcgccaattcaaggtcagtacagtacctgaagccgcaaagatagccaaactacacgagctctccctctcacatatgccaacaaagacatcgcgccccccattcaactcttctcaacgatcaaactactcccaacccaataaaagccaaaaccacaactccacctcccctactactaccgccaatccaaacaacaaacccctcattgcgaatgctcctcaaaaatggctttcttttgacgagatgcaggagcgcaaacgtaaaggattatgcatgttctgtgaagaaccgtttacaccaggtcaccaccttaagcataagcgcgctgaatttttgttcttggacttagacgctgagacagaatttgacgacgagattgcactagtggagcaaatccgtgagacaaccataagcgacgatgatgacaaagttccaactatctccgtccacgccctcaacggtgcgccaactttcaactgtatgcgcctcgtcaggaaatacgagaaacgtaaactacatatactgattgatccagggagcacacacaacttcttggacatccagatggctaagggattaggttgttctttgacaccaatcaaaccaatgtcagttgttgcagcaagtggcgacttggttactaagtacaagtgcagctcttttgcttggaagatgcaaggctacgggttcacagctgagattcgaaccttaccactaggatgcagtgatctcgtcctgggggttcaatggctttccaccttaggaccaatcctatgggatttcctaaaccttcgtatggagttcaaattcaacgagctaaaacatgtcttacgtggaatatcacccaacagctcaaaattaatttctggaagcagctttaacaaactgatgttgcaagatccacagcttgctctactccatcttcgcgagattgacgaaactacagagcaagaaccccttgaaccggaaacaattttctgtcatattgaagcgagtgaaacagagaacgacaattccggttcactcgagagactccttgattcatacacggacgtatttgatgagccgtcgaccttacctccttatcgcgcgggtttcaatcacaaaataccattggaagcaggatcaaatcctgtgaatctccgaccatatcgatactcttcgatacaaaaggattcaatagacaagatgattcaagacatgctttctcaaggtatcattcagtacagtgcaagtccctacgcttcacctattgtacttgtgaaaaagaaagacgggtcttggcggctttgtgtcgactacagaggtctcaataagcaaacgatcaaagacaaataccccatcccactactcgaagatctccttgatgaattgggcggctcaaagtacttctctaaactggatttacgtgcaggtttccaccagctttgtatgtctccagaagatgtgcacaagacagcttttaaaacacattcaggccactacgaatatttggtaatgccattcggcctcacaaacgcaccttgcacgtttcaggggcttatgaatcacgtattcgcacccgttctacgaaagtttctccttgttttcttcgacgatatattaatctacagcaagacctgggaggagcacctggatcacttggacaaggttcttgctatacttcgccatcaacaactctatctcaagaaatcaaagtgtacttttggaggaacgagaatcgaataccttggtcactttatttcccatgatggcgttagtactgacccaaccaagataaaggcagtcgaggaatggccacaaccgaagcaccagaaacacctccgcagcttcttaggtctagccaattactatcgaagattcatacaagggtacagcattatcgctcgaccccttaccatcatgcttcgcaaagacggttttgcttggaatacagaggcttcagacgcgttccatctcctcaaacaagcattaatctcggccccggtccttgcactccccgatttctccaagactttcatcgtcgaaaccgacgcttccaacactggcataggcgcaattcttatgcaggacaatcacccagtgtgctacataagtcgtgcattagggcctcgacaccaaggcctttctgtttacgagaaggaactccttgctgtggtccacgcagtacagacttggaacccttacttggctcacaacaagttcattattcggacagatcagaaaagtttgaagttcctactagaacagagatcaccactacattccaacatatgtggctatcaaaattaatgggttataactttgagattcagtataaagaaggcaaggaaaacgtcgctgcagatgctttatctagagtctccggttcccaactacttcagctctctctctctctcatgctcaccacgggttctatgattctttgaggatgctctgggatacataccctactctgaaacagatcattaccgacctgcaaaacaaacctgggtctcacgccgcgtactcctttgtcaacggagaacttcgccgccggggtaaacttgtggttggtaacgaccctgctatcaaacttcatatcttcaagtggcttcatgattctgctgtaggtggtcactcgggtcgagatgcaacactacaccgcatcaactcgttgttcttttggccaaagatgagcttggaggttcaaaactatgtccgcaactgtccagtttgccagaaaaataaatatgatttagctgcgaaacctggactcctctagccgttaccggttcctacgggtgtatgggagtctgtgagccttgactttatcgagggtctaccaccatcatcaggaaaacattgcattctcgtcgttattgatcgtttaagcaagaatgctcactttctcgccttgtctcatccgtacactgcaatggacgtggcaaagctatatatggatcaggtctttcgtcttcatgggatgcctaaagacattacaagcgatcgtgacccaacgtttctcagcgaggtttggagagagatgttccgcgttcatgtgtcgatttaaacttctccaccgcttaccatccacaaactgatggtcaaaccaaggttactaacaaaactttggaaacctatctccgatgcatgacttctgattcaccttctacatggagcgcgtggttacccttagcagaatggtggtataatactacttaccacactgcgattcgcagttcaccgttcgagatcatctatggccagccacctccagtgcacttgccttaccttcccggcgaaagtacttctaccacggttgacaggtccttacaacgaagggaagagctcattgacatgatgaagttccacctcttgcgagctcagaacaggatgaaacaatacgcagactcgcaccgttctgaacgtgcgtttcatattggtgactatgtctatttgaagctccagccgtatcgacaacattccctcaaaggacgacatttgcctcacaagctttcaccacgtttttatggtccgtacgagatacaagatcgtgttggtaacttggcatataagctacgtcttccatttgaagcagctatccataatgtcttccatgttagtcagctaaagctcggccccaacccgcctgcaactccttcgtcgcttccccaatacctcaaagatgtcggcactgcaaaggaaccagaaaagattcttgaaacaaaaatggtgaatcgccgaaacagagctgtcacgaaggtactagtacagtggaaaggctactctccggaacaagccacatgggagttctatcaagacttcgtcgcgaaacatcctgatttcaatacttgaggccaagtatcatctgaaggaggaagtattgtgacagcacaaatgtcatggtcgttaccacaccgccttatgttttcctatttagttttatttcctatttatcattatggaaaattatcgtttgttaagataatgatccaaagctttttccaattcggattttagcgttttatatataaggctatgcctcgatgatatatcaataataagaatcaagtttacaaatcatcttcctctttattactttctgtgcaagcaatacaatatccttacgatctcaggttcttagagctgatccttcttcctacgtgatcaactcctaggtctgtgaatccccttccttctaacctgcaagcaaggttactagtttgggacttgtaccccgttatcctatctcatagctttatgacctacattctgttctcggaagttaaggtcatgtatgtttcatgccatcagaagaattgttttttttcctgaaagttccatcaagaataattgttgttaccctcttaattgaaatggataaattgattttggtcacatgagcatgatgaacataaacaatcacataaactagaacttagaaaatgcagaggttaagaagttgattctggtaacatgatcatgaatctattgacgaacataaataaaaacacttatggatgccaaacaagcaaactcttgattataagaggtgtctagaagattggaggagtgaaggccttctctatgaatcatattagcatgagcaatcggcctagcttcattttggtgtctgactcacgccattcccatcagcggttcaaagtcatcttggcgaaaaaccttttgatgagatatagaaaatcagtttaattaaacacaaaccaaatttgaatgacttctccagcaatgttaaaaaagtaaagatgttgccatgacatacgcaggcgtatgttgacaaaccgaccaaagagtcttttaaaatttgacaacagttaaaaacggattctacagctaatatatgcattaggtataaacatcataaacctgattcaggtttatgattcagctaatatatgcagcaatccggtaatgaaacaaaatattaatggttcattagttagaaaaagattatcacgtgattaacaaagacttgtgtgatccttagtccaaaaaaaaaaaaaaacaaagacttatgcgacgacgacgacaaacaaaaaaaacaaagacttttgcgtctagttgggcttaaataataaacatataggcccacgcaaccgaatattgggaagtggacacgtcattagctaccttgcttccttccgacctttatcgtcttctgcccccaaacctcgagagagagagaatagagatcgaagcaaagaatcatcatcgaattacaacattctgaaattctcaccttcttccgatccacagattattccttcactgctctctcagtgtctaataatccttggaacgcttcctcgatgtcaaactcatagctctcgtcagcgtcacgatcgtctctttgcaatcgcgctcttagtaatccatcccagattcgattgctaccattctctatcccttttcctgatcccagtatttaattttcatccgcggctgaaaactccaaacattaggggaagatgattcattggggtggagtaacctgctgcctcagcgccgccgctctttatcttctcggccggagtagtggcagggacgctgaagtactcaaaaccgtcactagggttaaccaactcaaggagctaggtcatcttctcccccaaattgcttcatctactctctctcatatatattatttttgtctgattcttattaatacttgtttttcggatttactatgtattttgcagcgcaattgctagaattagatagcagcaagctccttcctttcatcgtagccgtttcaggaagagttggctctgacactcctatcaagtgcgagcatagtggcatacgcggcgttatcgtcgaggaaacggtacttattaatctagtttgtgtttcccgttttgtcagttaggtgtatctatgcaaatcatatatagttgatgtgtttcatcaggcggaacaacattttctgaaacacaatgagactggttcttgggtacaagatagtgcacttatgctatctatgagcaaggaggttccttggttcctggtatgtcaaaatatcaagtttgcttactgtttggatgtttttttttgaaaaacaatctctcgaatttcgaaattgtttgtgaaacaggacgatgggacaagtcgtgtgaatgtagtgggagctcgtggtgcaacaggttttgctttgaccgtcggaagtgaagtttttgaagagtcagggcggtctcttgtacggggaacacttgattatctccaaggccttaaggtatttttgcttttctattcggttgcttgtttgttgttattgacctctctatttgctttaagcgggtatcgttttggtttcagatgcttggagttaagcgcattgagcgtgttcttcctactggaatgcctctcacaattgttggtgaggtatgtcgtattctcagtgtcttcttttttgtttaaaatttcttaagaatagtatttgtagcaagctggattgatctttctgcagaggcagactgatgagtttgatttaatttctgttgcttgcatgtattgcaggctgtcaaggacgatattggggacctaaggattcagaaacctgaaagagggcctttctacgtctctcctaaatcactcgatcagctcatttctaatctggggaaatggtcaaggtcctctctctctctcctctctcacttggttcttcttctcctatgctatttcagaaaaagacgatgagccaaactgttttttacaggttgtacaagtatgcctccatgggtttaactgttttcggtgtgtttctaattacaaagcatgtcattgattttcttctagagagaagacagcggcgagaaatacagaaaaggtatgttaaacatttgtctgtctataaagcgaataattgtcctcaactagatcagttttgcttccctcggaaattatatacacaaaaatattaagcagtgtcagctgttgttgcagagtgcttgatgcagcagctaagagagctgggactgaaggtatccattgggtgaaatctttttattttccactcataaattggtagcacagtttctgaccacaaaacttttctctcaccaggttcaaacggcgcacatgagagcgtatcagattctaccaagaatgaaggcgctgttcctgatctctgtgtgatctgccttgagcagaactacaatgctgtgtttgtcccgtaagcattcttctgcttcattttggctgttttttacatttgcaaattgctaaaaagagcgtgtgttgttgttacttctcgcaggtgtggtcatatgtgctgctgcaccgcatgctcctcccatttgtccagctgtccactttgtcggagacgtatagatcaggtggttaagacatatcgtcactgagcaaaactcaactcagggctcagaagcattctctactcgagttgcctgtaaatactgcaagatcaaaacgatactaaattggtgttcgttatcctctcttgtttgccttcaagaacaatacatttgaactatataaaaacataaggtgtttgcagtaagttcgatttaattaatcttgccgctgccaatgacattaggtgtttgcagcttaacctgtttgaatcttccttgcttcactcttgattgactatatctgtctttttccccaaaacaagctttaagtgtttctcacaaaatgggagatactaaagcagagaagccagctccaacaatctgtacgattctcagctttgccattgttgtcttctttcgtgtagattattccttcagtaatattagtgttgagagaagagattgagtcgctttgttggcttgatcaaacccaagccttcttatctctttttccaccgtaaacacatgggcaccacattcaacaatgttgagttcgtggtaggtactgatgaattcgaacatcatctcattctcctgttcaagccatccatgttctttagcatataaatagatgtcccgcttggatgcatagacatgttcctgtcagtgaagcgaccctagtttatgcgcacgcgacacaaaaatctgctagctacttcaatctgtgtggtttaggggcaaccactgaaccacgatgcaaaacctaaattctctggaatctagtacataaaatagtttatatatatgctatgccggtttttgtgttacaaaaagaaattactatgtcaaatgtgaatcatgtcaatcgtataacttccaaatcatggctggattttaaacggttcaatattctatataattttcaatcaacaaatttgtttcttttatcaccttcatattctatgttttgttatcagtatcattggcatctcatccatctttcatttgtttcaggttatcaagttggatatcggccatatcgacccatcgatcacatctaagggcggtcggttagaacttagaacctcggaaaccaatctggtcgacccagattctgagacagagataatcagtatgacagatagatcctaactaggagctaaccaatagctctaagaaaggtgaatactagtctagaaggggactgtgagttttagaatagtcacctcgaagatgctagatccttaggatataagaacagagagttttagaggttggataaaatgatttctgatagatctctgcaaatgcaggagatgagtacaaatactaaagttcgagggtcacactaacggtctaaaacaatgacctgttaatgacgacaaaagcataaagtaaaagcataaagcaaaaggtgaaatgagctggatgtatttgctgactacgcctttttgtgatcaggttgttaggcgtgatactcctgtgacaatactcccttcttcagagcaaccttgtcctcaaggattgaaaagaggatacttgttggtgaagtccttgtagaactcccaagttgccatttcaggtgattcatctttccagtggactaaaacttttgttgcagcttcgttttggcgcttaacagtcttagtctccagaattgctgcaggttctttggtgttgccgaggtcaagccagtactgaggaaccgcaggggaggatgaagcagggtttgggcacagctttagttgactcacgtgaaatgtgtcatgaattgcagcttcagtaggcagcgagagtttgtaggcaaccttgccgatacggtctagcacacggaagggaccataaaagcgtggcgagagcttgtgtggagccttattctttttcactgtatgctggcgatatggctggagcttcaagtatacgtaatcaccgatcttgaactctcgctgggaacgctttgcatcggcatactgccgcatacggttctgagcgcgaagcaagtgaaatttaagcatgttaatcacttcctcacgcttctggaggctgcggtctacaacaacggaggagctttcacccggaaggtaagggaggtgaagtggtgggggttgaccgtagatgacctcgtatggagtagcttgaatggcagagtgaaaagtggtgttataccaccattctgcaagactgagccatttgctccaggatgttggtgtctcagcagccatacagcgtagataggtctccaaggtcttgttggttacctctgtttgaccgtcggtttgagggtggtaagcagtggagcgcttgagagtaaccccttgtacacggaagagctcgttccaaacctcactgataaagatcggatctctgtcactgatgacatctttgggcatgccatggagtttgaagatgttgtccaagaatgcctgagcaacagtgagggccgtgtatgggtgggacaagggtataaagtgtgcgttcttgctcatcctatcgaccactaccataatacagtgtttgccctgagacggcgggagaccttcaatgaagtctaggcttatagattcccagatcccatcaggaattggtagaggttgtagaagacccggtttggcagccatatcgtacttgttctgttggcagatactacagtttcgaatgtagttctggacctccacgtttagcttaggccaatagaacaaagatctgatacgatgtaaggttgcgtcacgtccagagtgtcccccaatggcagagtcgtgaagccatttgaagatgtgcaacttgatatctttatcgtttccaacgactagcttgcctcgacgtctcagctctccgtttgtgtatgtgaagagggggtgtgaagagctgttagatttcaagtcgcagataatcttctggagagtagcatcggtttcccagagtagcttcaacgaatcgtagaaaccagtatgagcctgagatagtaccatgttcagtaactgagagccagagactcgagagagagcgtcagcaacaacattgtctttcccttgcttgtagtggatctcgaagttgtagcccataagcttagagagccacatgtgctggaaaggtgtagttattttctgctccatgaggtacttgaggcttcgctgatcagtgttgatgatgaaagggcgatgcgcaaggtaggggtgccaggtttgcactgcgtgcactaatgccatcaactccttttcatacacagacaggttttggtggcggggaccaagggagcgacttatgaagcagatagggtgttttccctgcataaggaccgcaccaataccggtgtttgacgcgtctgtctcaacaatgaaaggttgatcaaagtcggggagggctaagacaggcgtggaactgagcgctgctttgaggtctgagaaggattgatcagcttcaagggaccaagtaaagccatcttttttcagtagcgtgctgagggggcgagcgatggagctataacctttgatgaagcggcggtaatagtttgccaatcccaagaagctccgtaggtgcttctgtgtcgtagggattggccaatcacgtattacagcaatctttcggggatcggtgctcacgccgtcagcagaaataaagtggccaaggtactctatgatcgttgcaccaatagtacatttagagagtttgagatacagctgttgttgttgcaggatcaggaagacctccgcaaggtgttgtaggtgttcctcccaagtcttgctgtatacaaggatgtcgtcgaaaaagacaagcactgatttccgagagaggtcttgaaatacatgattcataagactctggaaagtgcaaggggcgtttgtcaagccgaaaggcatgacaaggtattcatagtgcccttgatgtgtcttgaatgctgtcttgtagacgtcatcctccgacattcggagttggtgaaaacctgctcgaagatccaacttagagaagtacttggcgccaccaagttcatcgaggaggtcttctagcagagggatcagatacttgtccttgatcgtctgcttgttgagccctctgtaatccacacaaagacgccacgtgccatcttttttcttgaccaagacgatgggtgaggcgtaggggctagcactgtgctgaatgatcccttgagtcagcatttccttgatcatcgtatcgattgtatctttttgaagagaagagtaccgatacgggcgtaagttgacggggttggagcccgcaaggagtggtatctggtgatcaaaaccctctctaaacggtggcagtgacttaggttcttgaaagatatcttcaaacgtttgaagaagttgttggagagctgggtcgtcagcatttgttgttcccgaagcagagatgtgagagtacaacatttcaggattgaggctttgctggttgtcggcattctcatcaatctgttgtagctggattaaggctatttgaggttcttggagcatgagcttgttcaagctggagcccttaataaccttgcctcctgtcttaacgacgccacgaagtacatgtttggtgccagagagtgtgaactccattctgaggttgaggaagtcccaaagaataggtcccaaagtgcaaagccattgcactccaagcacaaaatcgcagcagtcaagagggacagtgcggatttccgtcgtaaaggaggagccttgaacggtccaagtgaaagccgagcacttgaagtttgtgagaagggtgtcaccagttgcagctttcactgacattgggcgcgttggttcgagctcacaacccagttgagtggcgatgttgaggtccacaaagttgtgggtacttccagggtctacaagtatatgcagcttgtgtttgccgtgatgaccaatcaagcgcatacagttgtaggaggtggagccgtttaaggcattgatggagatgactggtgtgacttcaacagtcgcttgcttgtcgtctgactctggctcggcatcagaggagctatcgtcagggatggtatcagcatcatcacactccatgacatagatctgagagcgcttgtgttttagttgatggccaggagtaaatggttcatcacaaaacatacataagcctttcgatcttctgtcttgcatttcctggtaggagaactttcgaggtggtttgtcagtggggtttcggggaataaaggagggtttttggttggtgggggcttgggttagaggtaggaggggggaagggttgtttggtttttggtagggttttgtgtttgggtaaggattgaagggggctctttgtcggtttggggtatgggagagagaggattcatggagcatagcaatctttgcagcgcccgcaatggaggttgtttcaaactgtctcgtgtggagagagagatgagggttcatgttagccaggaaaatgctaagagcatgagcctcaggaaggacaaggcgcatccttgtcgtctcaaacttgtcgagataggcagcaaccaaatcggagccttgcttgagggccactagctcagcaagagggtcgtcaaagagttcacaaaaacgagcagatatggcgattatatagtctgtccaagaggggaacatgccaaacctagtgctcatgtagtttgtgtgccattgagtagctcttccggtgagatgcatcgcagctaagcgtaccttcagctcctgtgaggtgccgtcgatatcaaagaactgctcacacttggaaagccagtcgcggaggtcagtgccatcgaactttgggaacgagattttggaaaggcgagatgtgagtctgccaaactcgttgtgttgacggaatccgttgagatctggggggtcaggtggttgggaagaaccgaggttgaagggtgtcggagggtgggaggggccggggtctagtggggcttttccggtggcgtggagcggtgaggcgttggcggagaacatcagggcctcgagtctgtcgaaacgagcgtcgagggagtcggaacgagacttaagctcagcagcgaggaggtcgtgtaaggaccgtaactcgtcaacttgctcagtcagagatctctcttggagtcgtgtttcaaccatggtttcggtaccgaggaaaggtgacttctgataccaatgagacagagataatcagtatgacagatagatcctaactaggagctaaccaatagctctaagaaaggtgaatactagtctagaaggggactgtgagttttagaatagtcacctcgaagatgctagatccttaggatataagaacagagagttttagaggttggataaaatgatttctgatagatctctgcaaatgcaggagatgagtacaaatactaaagttcgagggtcacactaacggtctaaaacaatgacctgttaatgacgacaaaagcataaagtaaaagcataaagcaaaaggtgaaatgagctggatgtatttgctgactacgcctttttgtgatcaggttgttaggcgtgatactcctgtgacagattccagcctgtattacttcgggatcttttttttctcaaattcctctatcgtccgttgagattcacttcttcggcggcactgagctcgaaattgtcgtctgctttggcggtactgttcactcaattcgtattcgtcctcactccattcgcgctcctcactcgattcatacggtgtcgcctgtaaaggattcgctgggttcaactcaaggctctcgtcgatcagactattaatatcgtcttcacatgattcgtacctcccatcagtgaggtaatcaatgtggtcttcagacacttggtctgatccagattcatagctcccttggatgctcttgtcttcaaacactttggcaccacattcaataacgtcgaattcgtgagatttgctgctgaattcgaacactgtctctctgctgacttcggaggggacgatgaatggcaagcgagggtgaaatataagtagatgttcagatcgatatctggagacatagcttacgcaaaactcctcaacaacggggtctaggtcgcctttgcttatgcagcggcacactaagtattctgaatgtctactttttttgctgatttgatggttaggtgacaccacaacgcaaagcttcaatatagatacagcagaaagaggattgttaccatagggaattctaatggtcaatgaacttcctctggctcggtgatcaaacttggcaggtactttttttcctggtaagataacccattcacaagacaaggaacggtggataatttctcttcgtgcttgttggcctaatttgaagcagttggtgaaatcgagtactgcatttggactgctattcaaagggcaaaacacggtctccagtgattcgcaatcttccgcatttaaggatttgatcgaaccagggagctctggcaatgatgcgagtcttctacatccatcaagggagagttgctctagctgatgaagatctttgatgcaatctggaatcgtctcaatatcagaataccgtaggtctagacatattagactcttgtggagatgtgttaatcccttgagtttcccacttttccttatacgagagtacataccagatgatggcggccgttgtcgaaaagagtccccacatatactcaatctcggtgaagtagttgaaataaacagaaactttctcaattttgaacatccgttcatttcgacaattccaagagaagccaagttcaggtggtctggaatgacttgtaggtttacgcaatcatccatccaccacaattctagtttctgaagatgcataaaagaggatggaatctctaccaaactcttgcaataactcatatccaatatcttcagatttgttgctcttgaaagatccgggagttccttcaactggcatgaaaatgacagatcaagcttcttgagatttgcaagccgctgaatttgagaaccacacaacaacagagggacatcatataacatgaagagaagataattcatatatatatatatatatatattaagtacatacaccaacctgggttcctttccagaggtgctcgaatttgccatgcttcatatcaagttccacgagatattcaggatgaaaggaaggaggaagacacttgttagggtatgcattccaatgtagaaaccttagacggcgtggaaacttcatctcctcaggtatatgtattacatcattcatatcatctctgcttttttccccagcaagaatgtcaaattttagtttgtcatctctgcttttgtagactttgagaaactgaagattatacattcttttaaaagctctttcgtcaacaatcaggtcgttgattcctgatatatcaaatgatatgccggacacagctctagttccctaaaccaaattacagataaaaaataaaaggttaggtccctatgtcagattttgcctagaatgactggtctgatataaaaataattaccaaggaatcaaacagatatatatatatatataaaaaagtggaaaagaatttactgtttcgttttcgaggacatcgcaaatctcatgcgcatccagtaagatttggcgtttccaaggctcttgtttatgaatggcttgtctacccactcgtcgtagtagcttgtgcatctcgattatattcccatatgtagatatctctatgagagatctatagactaggatctgcaaaccgcgtttgacatctattgtaccgtcagagaacatggctttcacaagatcactatcttcattgttgaagaagactgcaatgtggagaaatagggtttgctcattctcctctaaactttcatagcccacttttagcacgtcctctataccttgatcaagaatagtttccagtctgttcactacatcttcccattcgtccttcttcttcccacgtaaagatttacccaccacacatagagccaatggaagattaccacaaagccttattatccttgtacaaagcacctcaaaaccataaagtggagaccttagtctaaaagcacatctacataagatctcgatagcttcttcatcaaatggaaaccccacatggtaagtgctaccgataccatgttgctgcaaaatctctaggttttctgtggtcactacaatcctactcccaggaccaaaccatgcactctcattagccaacgcctctaattgctttagactgttcacgtcatcaagaatgataagcactttctggtcgcataggttttcttttactgcacctaaatggcatatcctcatgtccttgtggttcaaaacctttgaaagaaaattttcttgtaaccttttcttccaaccatattcgtcaagaccactaggacagatttccctaaggttgtccacaaaacaagtaagctggaacctacgggagagtagactatgtaaagctcgagctatggtagtcttaccgatccctgcaggaccagtgatggcaaccatcttaactccatcgtaatccagatctaacaaagactctatttcctttagatgagcatcaagtcccacaatgccttcaaaatctctacacggtgttgcattcagtttttgtaaaacatcttttgcaatcttcgcaatcattttagcttcattgacccttagataaaaaaaaaaaaacaatagaga

SEQ ID NO: 88 - protein, 707 aa, Raphanus sativum
MLARVCGFKCSSSPAESAARLFCTRSIRDTLAKASGESCEAGFGGESLKLQSGFHEIKGLEDAIDLFSDMLRSRPLPSVVDFCKLMGVVVRMERPDLVISLYQKMERKQIRCDIYSFNILIKCFCSCSKLPFALSTFGKITKLGLHPDVVTFTTLLHGLCVEDRVSEALDFFHQMFETTCRPNVVTFTTLMNGLCREGRIVEAVALLDRMMEDGLQPTQITYGTIVDGMCKKGDTVSALNLLRKMEEVSHIIPNVVIYSAIIDSLCKDGRHSDAQNLFTEMQEKGIFPDLFTYNSMIVGFCSSGRWSDAEQLLQEMLERKISPDVVTYNALINAFVKEGKFFEAEELYDEMLPRGIIPNTITYSSMIDGFCKQNRLDAAEHMFYLMATKGCSPNLITFNTLIDGYCGAKRIDDGMELLHEMTETGLVADTTTYNTLIHGFYLVGDLNAALDLLQEMISSGLCPDIVTCDTLLDGLCDNGKLKDALEMFKVMQKSKKDLDASHPFNGVEPDVQTYNILISGLINEGKFLEAEELYEEMPHRGIVPDTITYSSMIDGLCKQSRLDEATQMFDSMGSKSFSPNVVTFTTLINGYCKAGRVDDGLELFCEMGRRGIVANAITYITLICGFRKVGNINGALDIFQEMISSGVYPDTITIRNMLTGLWSKEELKRAVAMLEKLQMSMVCKFLFSLCIFYINKNVYILLCVASD

SEQ ID NO: 89 - DNA, 2124 bp, Raphanus sativum
  CDS (1)..(2121)
atgttggctagggtttgtggattcaagtgttcttcttctcctgctgagtctgcggctagattgttctgtacgagatcgattcgtgatactctggccaaggcaagcggagagagttgcgaagcaggttttggaggagagagtttgaagctgcaaagtgggtttcatgaaatcaaaggtttagaggatgcgattgatttgttcagtgacatgcttcgatctcgtcctttaccttctgtggttgatttctgtaaattgatgggtgtggtggtgagaatggaacgcccggatcttgtgatttctctctatcagaagatggaaaggaaacagattcgatgtgatatatacagcttcaatattctgataaaatgtttctgcagctgctctaagctcccctttgctttgtctacatttggtaagatcaccaagcttggactccaccctgatgttgttaccttcaccaccctgctccatggattatgtgtggaagatagggtttctgaagccttggatttttttcatcaaatgtttgaaacgacatgtaggcccaatgtcgtaaccttcaccactttgatgaacggtctttgccgcgagggtagaattgtcgaagccgtagctctgcttgatcggatgatggaagatggtctccagcctacccagattacttatggaacaatcgtagatgggatgtgtaagaagggagatactgtgtctgcactgaatctgctgaggaagatggaggaggtgagccacatcatacccaatgttgtaatctatagtgcaatcattgatagcctttgtaaagacggacgtcatagcgatgcacaaaatcttttcactgaaatgcaagagaaaggaatctttcccgatttatttacctacaacagtatgatagttggtttttgtagctctggtagatggagcgacgcggagcagttgttgcaagaaatgttagaaaggaagatcagccctgatgttgtaacttataatgctttgatcaatgcatttgtcaaggaaggcaagttctttgaggctgaagaattatacgatgagatgcttccaaggggtataatccctaatacaatcacatatagttcaatgatcgatggattttgcaaacagaatcgtcttgatgctgctgagcacatgttttatttgatggctaccaagggctgctctcccaacctaatcactttcaatactctcatagacggatattgtggggctaagaggatagatgatggaatggaacttctccatgagatgactgaaacaggattagttgctgacacaactacttacaacactcttattcacgggttctatctggtgggcgatcttaatgctgctctagaccttttacaagagatgatctctagtggtttgtgccctgatatcgttacttgtgacactttgctggatggtctctgcgataatgggaaactaaaagatgcattggaaatgtttaaggttatgcagaagagtaagaaggatcttgatgctagtcaccccttcaatggtgtggaacctgatgttcaaacttacaatatattgatcagcggcttgatcaatgaagggaagtttttagaggccgaggaattatacgaggagatgccccacaggggtatagtcccagatactatcacctatagctcaatgatcgatggattatgcaagcagagccgcctagatgaggctacacaaatgtttgattcgatgggtagcaagagcttctctccaaacgtagtgacctttactacactcattaatggctactgtaaggcaggaagggttgatgatgggctggagcttttctgcgagatgggtcgaagagggatagttgctaacgcaattacttacatcactttgatttgtggttttcgtaaagtgggtaatattaatggggctctagacattttccaggagatgatttcaagtggtgtgtatcctgataccattaccatccgcaatatgctgactggtttatggagtaaagaggaactaaaaagggcagtggcaatgcttgagaaactgcagatgagtatggtatgtaagtttctgttcagtctatgtattttttatataaacaagaatgtatacattcttttgtgtgtagcttcagattga

SEQ ID NO: 90 - protein, 35 aa, Raphanus sativum
VTYNTLISGYCKAGKLEEALELFKEMKEKGIKPDV

SEQ ID NO: 91 - protein, 24 aa, Raphanus sativum
  MOD_RES (12): Variable amino acid as described in the application as filed
  MOD_RES (13): Variable amino acid
  MOD_RES (17): Variable amino acid
  MOD_RES (19): Variable amino acid
  MOD_RES (22): Variable amino acid
GTPNLAAQGTTXXTPAXQXYPXMF

SEQ ID NO: 92 - protein, 33 aa, Raphanus sativum
  MOD_RES (6): Variable amino acid as described in the application as filed
  MOD_RES (8): Variable amino acid
  MOD_RES (10): Variable amino acid
  MOD_RES (17): Variable amino acid
  MOD_RES (30): Variable amino acid as described in the application as filed
  MOD_RES (31): Variable amino acid
PVSSEXPXQXLGSTSDXSSGTETTPLAPPXXTT

SEQ ID NO: 93 - protein, 32 aa, Raphanus sativum
PVSSEPVQPLGSTSDESSGTETTPLAPPPVTT

SEQ ID NO: 94 - protein, 32 aa, Raphanus sativum
PVSSEQPAQALGSTSDQSSGTETTPLAPPITT

SEQ ID NO: 95 - protein, 28 aa, Raphanus sativum
PVSSEPVQRLGSTSDQCSGTHTTPLAPP

SEQ ID NO: 96 - protein, 24 aa, Raphanus sativum
  MOD_RES (12): Variable amino acid as decribed in the application as filed
  MOD_RES (13): Variable amino acid
  MOD_RES (17): Variable amino acid
  MOD_RES (19): Variable amino acid
  MOD_RES (22): Variable amino acid
GTPNLAAQGTTXXTPAXQXYPXMF

SEQ ID NO: 97 - protein, 23 aa, Raphanus sativum
GSPNLATYGTTAIPAVQAYAIMF

SEQ ID NO: 98 - protein, 23 aa, Raphanus sativum
GAPNFTSQGTTATPAFQAFPIMF

SEQ ID NO: 99 - protein, 23 aa, Raphanus sativum
GTPNLAAQGTTRAPAVQAYPTMF

SEQ ID NO: 100 - protein, 21 aa, Raphanus sativum
GTPNIGVQGSTPAAQTYPLMF

SEQ ID NO: 101 - protein, 29 aa, Raphanus sativum
GTPNLAAQGTTNIGARGTTPAAQAYPLMF

SEQ ID NO: 102 - protein, 22 aa, Raphanus sativum
GTPNLAAQGTTTPAVQSYPTMF

SEQ ID NO: 103 - protein, 23 aa, Raphanus sativum
GTPNLAGQSTTTTRAGQPYPTTF

SEQ ID NO: 104 - protein, 18 aa, Raphanus sativum
AVPQAATAPAVQPYAMMF

SEQ ID NO: 105 - protein, 19 aa, Raphanus sativum
GTPSLGAQDITPGGQAYPA

SEQ ID NO: 106 - protein, 21 aa, Raphanus sativum
ATPNLAAYGTTPAVQAYPMMF

SEQ ID NO: 107 - protein, 22 aa, Raphanus sativum
GIPNLAAQGTATPSVQAYPMIF

SEQ ID NO: 108 - protein, 23 aa, Raphanus sativum
GIPNLAAQGTTATPAFQAYPMIF

SEQ ID NO: 109 - protein, 24 aa, Raphanus sativum
GIPNVAAQGTTTTTPAAQAYPMMF

SEQ ID NO: 110 - protein, 22 aa, Raphanus sativum
GIPNLAAQGTTTPAAQPYPTMF

SEQ ID NO: 111 - protein, 23 aa, Raphanus sativum
GTPSLAAQGTTTAPAVQPYPTMY

SEQ ID NO: 112 - protein, 21 aa, Raphanus sativum
GTPNFVAQGMTPAAQAYPVNG

SEQ ID NO: 113 - protein, 35 aa, Raphanus sativum
VTYNSLISGYCKAGKLEEALELFKEMKEKGIKPDV

SEQ ID NO: 114 - protein, 35 aa, Raphanus sativum
YSFNILIKCFCSCSKLPFALSTFGKITKLGLHPDV

SEQ ID NO: 115 - protein, 35 aa, Raphanus sativum
VTFTTLLHGLCVEDRVSEALDFFHQMFETTCRPNV

SEQ ID NO: 116 - protein, 34 aa, Raphanus sativum
VTFTTLMNGLCREGRIVEAVALLDRMMEDGLQPT

SEQ ID NO: 117 - protein, 36 aa, Raphanus sativum
ITYGTIVDGMCKKGDTVSALNLLRKMEEVSHIIPNV

SEQ ID NO: 118 - protein, 34 aa, Raphanus sativum
VIYSAIIDSLCKDGRHSDAQNLFTEMQEKGIFPD

SEQ ID NO: 119 - protein, 35 aa, Raphanus sativum
FTYNSMIVGFCSSGRWSDAEQLLQEMLERKISPDV

SEQ ID NO: 120 - protein, 35 aa, Raphanus sativum
VTYNALINAFVKEGKFFEAEELYDEMLPRGIIPNT

SEQ ID NO: 121 - protein, 34 aa, Raphanus sativum
ITYSSMIDGFCKQNRLDAAEHMFYLMATKGCSPN

SEQ ID NO: 122 - protein, 35 aa, Raphanus sativum
ITFNTLIDGYCGAKRIDDGMELLHEMTETGLVADT

SEQ ID NO: 123 - protein, 33 aa, Raphanus sativum
TYNTLIHGFYLVGDLNAALDLLQEMISSGLCPD

SEQ ID NO: 124 - protein, 46 aa, Raphanus sativum
VTCDTLLDGLCDNGKLKDALEMFKVMQKSKKDLDASHPFNGVEPDV

SEQ ID NO: 125 - protein, 34 aa, Raphanus sativum
TYNILISGLINEGKFLEAEELYEEMPHRGIVPDT

SEQ ID NO: 126 - protein, 35 aa, Raphanus sativum
ITYSSMIDGLCKQSRLDEATQMFDSMGSKSFSPNV

SEQ ID NO: 127 - protein, 34 aa, Raphanus sativum
VTFTTLINGYCKAGRVDDGLELFCEMGRRGIVAN

SEQ ID NO: 128 - protein, 35 aa, Raphanus sativum
ITYITLICGFRKVGNINGALDIFQEMISSGVYPDT

We claim:

1. An isolated nuclear fertility restorer nucleic acid selected from the group consisting of:
   a) a nucleic acid comprising the gene within positions 103,375 and 105,589 of the nucleotide sequence of SEQ ID NO:87;
   b) a nucleic acid encoding a protein comprising the amino acid sequence encoded by the gene within positions 103,375 and 105,589 of the nucleotide sequence of SEQ ID NO:87;
   c) a nucleic acid comprising a nucleotide sequence differing from the sequence of the nucleic acids of a) or b) due to the degeneracy of the genetic code; and
   d) a nucleic acid having at least 90% homology with the nucleic acid sequences of a) or b), wherein sequence homology is determined by the Karlin and Altschul algorithm using standard parameters and wherein the nucleic acid encodes a nuclear fertility restorer protein.

2. The nucleic acid of claim 1, wherein the nucleic acid comprises the nucleotide sequence of SEQ ID NO:32.

3. The nucleic acid of claim 1, wherein the nucleic acid encodes a protein comprising the amino acid sequence of SEQ ID NO:31.

4. The nucleic acid of claim 1, wherein the nucleic acid comprises a nucleotide sequence differing from the sequence of the nucleic acids of a) or b) of claim 1 due to the degeneracy of the genetic code.

5. The nucleic acid of claim 1, wherein the nucleic acid has at least 95% homology with the nucleotide sequence shown in SEQ ID NO:32, wherein sequence homology is determined by the Karlin and Altschul algorithm using standard parameters, and wherein the nucleic acid encodes a nuclear fertility restorer protein.

6. A vector comprising the nucleic acid of claim 1.

7. A first isolated nucleic acid that hybridizes under highly stringent conditions to a second nucleic acid selected from the group consisting of:
   a) a second nucleic acid comprising the nucleotide sequence shown in SEQ ID NO:32; and
   b) a second nucleic acid encoding a protein comprising the amino acid sequence shown in SEQ ID NO:31,
wherein the first nucleic acid encodes a nuclear fertility restorer protein.

8. A transgenic plant cell, wherein the plant cell comprises a transgene comprising the nucleic acid of claim 1.

9. A transgenic plant comprising the plant cell of claim 8.

10. The transgenic plant of claim 9, wherein the plant is a hybrid.

11. The transgenic plant of claim 9 or 10, wherein the plant is a *Brassica napus* plant.

12. A seed produced by the plant of claim 11, wherein the seed comprises the isolated nuclear fertility restorer nucleic acid.

13. The seed of claim 12, wherein the nucleic acid comprises the nucleotide sequence of SEQ ID NO:32.

14. The seed of claim 12, wherein the nucleic acid encodes a protein comprising the amino acid sequence of SEQ ID NO:31.

15. A method of producing a hybrid *Brassica* or radish plant, comprising crossing an Ogura cytoplasmic male-sterile *Brassica* or radish plant with a male-fertile *Brassica* or radish plant, collecting hybrid seed from the Ogura cytoplasmic male-sterile *Brassica* or radish plant and regenerating the hybrid plant from the seed, wherein the hybrid plant does not have elevated glucosinolate levels as compared to an untransformed wild type variety of the plant, and wherein the male-fertile plant comprises a nuclear fertility restorer nucleic acid transgene comprising a sequence selected from the group consisting of:
   a) a nucleic acid comprising the gene within positions 103,375 and 105,589 the nucleotide sequence of SEQ ID NO:87;
   b) a nucleic acid encoding a protein comprising the amino acid sequence encoded by the gene within positions 103,375 and 105,589 of the nucleotide sequence of SEQ ID NO:87;
   c) a nucleic acid comprising a nucleotide sequence differing from the sequence of the nucleic acids of a) or b) due to the degeneracy of the genetic code; and
   d) a nucleic acid having at least 90% homology with the nucleic acids of a) or b), wherein sequence homology is determined by the Karlin and Altschul algorithm using standard parameters and wherein the nucleic acid encodes a nuclear fertility restorer protein.

16. The method of claim 15, wherein the nucleic acid comprises the nucleotide sequence of SEQ ID NO:32.

17. The method of claim 15, wherein the nucleic acid encodes a protein comprising the amino acid sequence of SEQ ID NO:31.

18. The method of claim 15, wherein the nucleic acid comprises a nucleotide sequence differing from the sequence of the nucleic acids of a) or b) of claim 26 due to the degeneracy of the genetic code.

19. The method of claim 15, wherein the nucleic acid has at least 95% homology with the nucleotide sequence shown in SEQ ID NO:32, wherein sequence homology is determined by the Karlin and Altschul algorithm using standard parameters, and wherein the nucleic acid encodes a nuclear fertility restorer protein.

20. The method of claim 15, wherein the hybrid plant is a *Brassica napus* plant.

21. A method of increasing production of viable pollen in a *Brassica* or radish plant, comprising introducing a nuclear fertility restorer nucleic acid transgene into the plant, wherein the nuclear fertility restorer nucleic acid transgene is selected from the group consisting of:

a) a nucleic acid comprising the gene within positions 103,375 and 105,589 the nucleotide sequence of SEQ ID NO:87;
b) a nucleic acid encoding a protein comprising the amino acid sequence shown encoded by the gene within positions 103,375 and 105,589 of the nucleotide sequence of SEQ ID NO:87;
c) a nucleic acid comprising a nucleotide sequence differing from the sequence of the nucleic acids of a) or b) due to the degeneracy of the genetic code; and
d) a nucleic acid having at least 90% homology with the nucleic acids of a) or b), wherein sequence homology is determined by the Karlin and Altschul algorithm using standard parameters and wherein the nucleic acid encodes a nuclear fertility restorer protein;

and wherein the plant does not have elevated glucosinolate levels as compared to an untransformed wild type variety of the plant.

22. The method of claim 21, wherein the plant comprises a cytoplasmic male-sterility determinant.

23. The method of claim 22, wherein the plant comprises an ogu cytoplasmic male sterility determinant.

24. The method of claim 21, wherein the plant is a *Brassica napus* plant.

25. The method of claim 21, wherein the nucleic acid comprises the nucleotide sequence of SEQ ID NO:32.

26. The method of claim 21, wherein the nucleic acid encodes a protein comprising the amino acid sequence of SEQ ID NO:31.

27. The method of claim 21, wherein the nucleic acid comprises a nucleotide sequence differing from the sequence of the nucleic acids of a) or b) of claim 21 due to the degeneracy of the genetic code.

28. The method of claim 21, wherein the nucleic acid has at least 95% homology with the nucleotide sequence of SEQ ID NO:32 wherein sequence homology is determined by the Karlin and Altschul algorithm using standard parameters, and wherein the nucleic acid encodes a nuclear fertility restorer protein.

* * * * *